United States Patent 6,812,339 (POLYMORPHISMS IN KNOWN GENES ASSOCIATED WITH HUMAN DISEASE, METHODS OF DETECTION AND USES THEREOF) - sequence listing, part 111

SEQ ID NO: 203989 - DNA, 601 bp, Human
cattataacctgctgccagttgttagtgatcgtcttatttttcttcttgcccataaacctctcccaaacactggtttgtctcattaaaaatgacatacacagtgagaagagaagaacatcaaattgagagagataattagcaagagccaagcctaagagaagggcaggtgtatgtggttcattaggccaaaagggaatgaaaatccaattggatctcagatcaggcaccttggctaagttaaagctcacagaaatgctgaagttagcacattataatatatctgtgtatatgtatatatgmatatatcatatatattgtttcatacctattatatatgtaatatttaaaaaatcacatttttgtgtcttagcacatgaacatcaatttcctcttcagtaaagtgagaataacttccctgaccaccctcataagaatttgatccatcaatctcattattgagtatatatctaaaggaaaatcaatcattctaggaaaaagacacactcacaactatgttcattgtagcaccattcacagtaacaaagaaatgaaatcaacctagaaactcatcaatggaaaactggacaagaaaactgtgat

SEQ ID NO: 203990 - DNA, 601 bp, Human
ctaataactgacctatgatcacccactgtcagctttagagaacaaggtatcaaggaacagagagtcacagaatggagaagttctgatggaggagagatgatgaagtgagattcagtgcttaagtaaaaagtggagtgaggacgctaagttatctcaggagagggaagaagggggagtaaatgtgaaaagacaaactgaattttgatggaaatctgatatgtgatggatgttgtccacattaagatgacacctaaaaaaactatgcaaggatattaattactaaggaaggaatttctgacaygacaactgggtagaggatatcctttcagacaggagggttttgtgaaggctctgaagttacttattctatgtgtctattcctacttctttttattactgcacattcaaatagccatacgaattaaatcttaaaggatactttttttttgtgcaagaaatctgtccccatgatcatttctgcacctgctatggtgacaatattgttattggcactggaagtaaatgtctggtcttacaactggcccccaatttttctttacccataagcatttgacttatgttgaaagcttccttctaatga

SEQ ID NO: 203991 - DNA, 601 bp, Human
cctgctacttaactattatgacgttgtcttctaagaagcagaaaaatcctattatctatggctaaaggattccatctaataactgacctatgatcacccactgtcagctttagagaacaaggtatcaaggaacagagagtcacagaatggagaagttctgatggaggagagatgatgaagtgagattcagtgcttaagtaaaaagtggagtgaggacgctaagttatctcaggagagggaagaagggggagtaaatgtgaaaagacaaactgaattttgatggaaatctgatatgtgatgratgttgtccacattaagatgacacctaaaaaaactatgcaaggatattaattactaaggaaggaatttctgacacgacaactgggtagaggatatcctttcagacaggagggttttgtgaaggctctgaagttacttattctatgtgtctattcctacttctttttattactgcacattcaaatagccatacgaattaaatcttaaaggatactttttttttgtgcaagaaatctgtccccatgatcatttctgcacctgctatggtgacaatattgttattggcactggaagtaaatgt

SEQ ID NO: 203992 - DNA, 601 bp, Human
aattgactcaccaagggtcatgaatgctcatttgttcagagaagaaggatgctgagagataagaaagagaagaggaagggacatttccatctatcatgaggtgtcaggtggaaaatgaaaggctggcttccctcttccaagcagaatcagctttatgcattaggaaggaatttaagtatggggaaaagctcctgcagaatctaaaagaatcccccttccccaagctaccccccatctggatatattacaattcagatgttgaaaacacatacaatcagcctgctacttaactattatgacrttgtcttctaagaagcagaaaaatcctattatctatggctaaaggattccatctaataactgacctatgatcacccactgtcagctttagagaacaaggtatcaaggaacagagagtcacagaatggagaagttctgatggaggagagatgatgaagtgagattcagtgcttaagtaaaaagtggagtgaggacgctaagttatctcaggagagggaagaagggggagtaaatgtgaaaagacaaactgaattttgatggaaatctgatatgtgatggatgttgtccacattaagatgac

SEQ ID NO: 203993 - DNA, 601 bp, Human
tgattataaaataattgaatacactggggtgtatctggccttctgtttaaatgaaattgactcaccaagggtcatgaatgctcatttgttcagagaagaaggatgctgagagataagaaagagaagaggaagggacatttccatctatcatgaggtgtcaggtggaaaatgaaaggctggcttccctcttccaagcagaatcagctttatgcattaggaaggaatttaagtatggggaaaagctcctgcagaatctaaaagaatcccccttccccaagctaccccccatctggatatattrcaattcagatgttgaaaacacatacaatcagcctgctacttaactattatgacgttgtcttctaagaagcagaaaaatcctattatctatggctaaaggattccatctaataactgacctatgatcacccactgtcagctttagagaacaaggtatcaaggaacagagagtcacagaatggagaagttctgatggaggagagatgatgaagtgagattcagtgcttaagtaaaaagtggagtgaggacgctaagttatctcaggagagggaagaagggggagtaaatgtgaaaagacaaa

SEQ ID NO: 203994 - DNA, 601 bp, Human
attgattataaaataattgaatacactggggtgtatctggccttctgtttaaatgaaattgactcaccaagggtcatgaatgctcatttgttcagagaagaaggatgctgagagataagaaagagaagaggaagggacatttccatctatcatgaggtgtcaggtggaaaatgaaaggctggcttccctcttccaagcagaatcagctttatgcattaggaaggaatttaagtatggggaaaagctcctgcagaatctaaaagaatcccccttccccaagctaccccccatctggatataytacaattcagatgttgaaaacacatacaatcagcctgctacttaactattatgacgttgtcttctaagaagcagaaaaatcctattatctatggctaaaggattccatctaataactgacctatgatcacccactgtcagctttagagaacaaggtatcaaggaacagagagtcacagaatggagaagttctgatggaggagagatgatgaagtgagattcagtgcttaagtaaaaagtggagtgaggacgctaagttatctcaggagagggaagaagggggagtaaatgtgaaaagaca

SEQ ID NO: 203995 - DNA, 601 bp, Human
gccgaaaagggaattgattataaaataattgaatacactggggtgtatctggccttctgtttaaatgaaattgactcaccaagggtcatgaatgctcatttgttcagagaagaaggatgctgagagataagaaagagaagaggaagggacatttccatctatcatgaggtgtcaggtggaaaatgaaaggctggcttccctcttccaagcagaatcagctttatgcattaggaaggaatttaagtatggggaaaagctcctgcagaatctaaaagaatcccccttccccaagctaccccccatctggatatattacaattcagatgttgaaaacacatacaatcagcctgctacttaactattatgacgttgtcttctaagaagcagaaaaatcctattatctatggctaaaggattccatctaataactgacctatgatcacccactgtcagctttagagaacaaggtatcaaggaacagagagtcacagaatggagaagttctgatggaggagagatgatgaagtgagattcagtgcttaagtaaaaagtggagtgaggacgctaagttatctcaggagagggaagaagggggagtaaa

SEQ ID NO: 203996 - DNA, 601 bp, Human
ttcagagggtggagagtgggaggaaggagaggatcagaaaaaataactaatggttactaggcttaatacctgggtgaagaaatctgtacaacaaatcaccatgacacaagtttacctatataacaaacctgcacatgcactcatgaacttaacataaatttcaaattaaaatataaaaaaataggcaaacccatacacacatatgtatatacacacaaaatagtctagaacaatgtactaatttttaaacatggttgtctctgggtagatataaaattattatttttcttctttctttctytactctttcgccatagaaaagatatattatgcattgctagttattttctgtgtgatgagctcttgaatggacttgtttgccagagtttaagtgtttgatgcctgctaaagaataactgtttgcttttctaaataactcaaacttttcacttccctttctcttgtgcaaccaggcatcctctcagataaattagtttgactctactcaaataagctctgttgtggcaacagtggacatcctgtccattctactcatggtaaagtctcctgtatcctctgtattagatcaggaagttgtttg

SEQ ID NO: 203997 - DNA, 601 bp, Human
ccgcctgcctcagcctccgaaagtgcgaggattacaggcatgagccatcacaccaggtccatgttctcacttataaatgggaactaaatgatgagaacacatggacacatagaggagaacagcacatactggggcctttcagagggtggagagtgggaggaaggagaggatcagaaaaaataactaatggttactaggcttaatacctgggtgaagaaatctgtacaacaaatcaccatgacacaagtttacctatataacaaacctgcacatgcactcatgaacttaacataaatttcarattaaaatataaaaaaataggcaaacccatacacacatatgtatatacacacaaaatagtctagaacaatgtactaatttttaaacatggttgtctctgggtagatataaaattattatttttcttctttctttctttactctttcgccatagaaaagatatattatgcattgctagttattttctgtgtgatgagctcttgaatggacttgtttgccagagtttaagtgtttgatgcctgctaaagaataactgtttgcttttctaaataactcaaacttttcacttccctttctcttg

SEQ ID NO: 203998 - DNA, 601 bp, Human
cacttatttattgatttatttttaagacagggtcttggtctgtcgcccaggctggagtgcagtggcacaatcttggctagttgtaaccaccatctccagggttcaagcgactctcatacctcagcctcctgagtagctaggactacaggcgtgcaccaccatgcccggctcatttttgtatttttagtagagatggggttttgccatgttggccaaggtggtctcaaactcctgacctctattgatccgcctgcctcagcctccgaaagtgcgaggattacaggcatgagccatcacaccmggtccatgttctcacttataaatgggaactaaatgatgagaacacatggacacatagaggagaacagcacatactggggcctttcagagggtggagagtgggaggaaggagaggatcagaaaaaataactaatggttactaggcttaatacctgggtgaagaaatctgtacaacaaatcaccatgacacaagtttacctatataacaaacctgcacatgcactcatgaacttaacataaatttcaaattaaaatataaaaaaataggcaaacccatacacacatatgtatatacacacaa

SEQ ID NO: 203999 - DNA, 601 bp, Human
tttgtttaaataggcataccccatatacaccatggaatactatgcagccataaaaaagaatgagatcatgtcccttgcagggacatggatggagttgaaggccattatccttagcaaattaatgcaggaacagaaaaccaaataccacatgttctcacttatttattgatttatttttaagacagggtcttggtctgtcgcccaggctggagtgcagtggcacaatcttggctagttgtaaccaccatctccagggttcaagcgactctcatacctcagcctcctgagtagctaggactayaggcgtgcaccaccatgcccggctcatttttgtatttttagtagagatggggttttgccatgttggccaaggtggtctcaaactcctgacctctattgatccgcctgcctcagcctccgaaagtgcgaggattacaggcatgagccatcacaccaggtccatgttctcacttataaatgggaactaaatgatgagaacacatggacacatagaggagaacagcacatactggggcctttcagagggtggagagtgggaggaaggagaggatcagaaaaaataactaatggttactaggct

SEQ ID NO: 204000 - DNA, 601 bp, Human
taaaatacagaatatatcacatggtcttatttattatttttgtttaaataggcataccccatatacaccatggaatactatgcagccataaaaaagaatgagatcatgtcccttgcagggacatggatggagttgaaggccattatccttagcaaattaatgcaggaacagaaaaccaaataccacatgttctcacttatttattgatttatttttaagacagggtcttggtctgtcgcccaggctggagtgcagtggcacaatcttggctagttgtaaccaccatctccagggttcaagmgactctcatacctcagcctcctgagtagctaggactacaggcgtgcaccaccatgcccggctcatttttgtatttttagtagagatggggttttgccatgttggccaaggtggtctcaaactcctgacctctattgatccgcctgcctcagcctccgaaagtgcgaggattacaggcatgagccatcacaccaggtccatgttctcacttataaatgggaactaaatgatgagaacacatggacacatagaggagaacagcacatactggggcctttcagagggtggagagtgggaggaa

SEQ ID NO: 204001 - DNA, 601 bp, Human
gattatgctattggtaagactttggtcaacagtagggtattagtggttaagtgagtacagagtcaaaagttatatgtgaattttcaatagcgcagagattgctgccccaagccccgtgttgttcaagggtcaactgtggttgcaacagagatcttataacccacaaagcctaaaatatttactctttggctctttacagaaaaaatttacctaccccagctttagcttttcacatctaaataaaccaagtggtcatttttctaaataaaagttacagtctttccttaagattaactgtgcygtttactatgatatcaagatgaatagacaggcagctttcaaaataatgatttctttccgttattcagtataataaacattcagtattactggacatgggagaaatggcatttcctatattcaggctatagactgaaaccatgtttccagggacagtttaatcatcttgaaaatgtgcatggtgtttagtccattcatgcaactttaattaatttatcctaaggaaatcagtaagtattgaacaaggattcagtcagtcacaaggatgtcatcatgaatagtttgtaatagggagcaacat

SEQ ID NO: 204002 - DNA, 601 bp, Human
acctcctggggatgtttctttttccacctactccttgggaggagcccttcctagctccctcatttgtcagtaacattttactgaaggctttagaaacatggaggagaactcttatttggagcaaaacaggaaatatcttaaaattaattttagacatgatgcaattcctcagctgaatttcttcagccacccacccaaaccatagtgaatttctctctggaaggctttctctgtaatccttaacagctgccatgacgctggacactctctctcaccccaaagtcttgtcccactgcccccrtatctttactgcctctaactgctgcctctcctcccaagagttactccgtcatgcaccctattattgctctgttttggtctgaatctaatccttacagaccatgcccaagggtctatcccaggggttggttcaccccagctctgtgggtccaatccacctgtgtttgtaaataaagttttattggaacacagtcacactcattatccacgacagtttggtgccactgcagagttgagcagagttgagccttgaacaacataggtttgaactgcataggttcacttatacttggactttctt

SEQ ID NO: 204003 - DNA, 601 bp, Human
aaattccagaagagaagcagaattacattctgctgtcacagtttgtctggattccctcacctagattaattctcagacactccattcaccatgacacctcctggggatgtttctttttccacctactccttgggaggagcccttcctagctccctcatttgtcagtaacattttactgaaggctttagaaacatggaggagaactcttatttggagcaaaacaggaaatatcttaaaattaattttagacatgatgcaattcctcagctgaatttcttcagccacccacccaaaccatagkgaatttctctctggaaggctttctctgtaatccttaacagctgccatgacgctggacactctctctcaccccaaagtcttgtcccactgcccccgtatctttactgcctctaactgctgcctctcctcccaagagttactccgtcatgcaccctattattgctctgttttggtctgaatctaatccttacagaccatgcccaagggtctatcccaggggttggttcaccccagctctgtgggtccaatccacctgtgtttgtaaataaagttttattggaacacagtcacactcattatc

SEQ ID NO: 204004 - DNA, 601 bp, Human
ctttcttttattatccaaataaaatggctggttactctccatgacaacttcttgcccccaaatccatcgtctttcttgatgtcctgagagactgacctctgtgggcttcattaaccagtcttgcttgtcctctgacttctatttggtgcagacattaggaccataggcagaagaacaaatgtggaaaaaaagaggtctcggtggttattttaactgtcctgcccaactaggttcctctctgctcttggctgcacagagccacaagtgttagcagtggggcagagtggagagtcttccctgmctgcagctttcatcagcccctgttgatgcatctccctctccagcctcccatgcttggggtgctgatggctccccactgtcactagtccctgacatcatccccatcgtggttggttacataacctgggtcacacctctactccagcattccatccatttcctgccaggaccttgcccgatatagccccatcctacagacggagagaagccagcattccccaggggacttctgaaaattccagaagagaagcagaattacattctgctgtcacagtttgtctggattccctcacctagatta

SEQ ID NO: 204005 - DNA, 601 bp, Human
tattacatgaaataatataataccataatttggtagattttaaaaatatagatatcccaagttccacagctttcttttattatccaaataaaatggctggttactctccatgacaacttcttgcccccaaatccatcgtctttcttgatgtcctgagagactgacctctgtgggcttcattaaccagtcttgcttgtcctctgacttctatttggtgcagacattaggaccataggcagaagaacaaatgtggaaaaaaagaggtctcggtggttattttaactgtcctgcccaactagggtcctctctgctcttggctgcacagagccacaagtgttagcagtggggcagagtggagagtcttccctgactgcagctttcatcagcccctgttgatgcatctccctctccagcctcccatgcttggggtgctgatggctccccactgtcactagtccctgacatcatccccatcgtggttggttacataacctgggtcacacctctactccagcattccatccatttcctgccaggaccttgcccgatatagccccatcctacagacggagagaagccagcattccccaggggacttctg

SEQ ID NO: 204006 - DNA, 601 bp, Human
gtggcccatgcctgtaatcctaacagtttgggaagacaaggcaggaggatcgcttgaagccaggagttcaagaccagcctgggtgacatagtatactttgtctctacacaaaataaaaattagttagccggccatggtggcatatgcctgtggtcccagttacttgggaggctgaggcaggaggatcgcttgagcctaggagtttgaggctgcagtgagctaagatcgtgccactgcactcaagcctgggtgaccctgtctcaatttttttttttttttgcaagggaatccctcatacaaraaggtaatgggatggggaaattcaggtcttcacttcgatttatttccagttccattgggaagagaagctgattaaatcaatgcttggaagagtacatctacatctcttactctaaaaattaactagcacctctcctttccttctaagaactaatgcatccatttaagcaaatgaagatcaatgttagcaatgcaatttgctgcaacagaaaaacgtacaaagattccttgagctacacaagaaaacaatcatttgtcttagcccctctaccaaccctggaagctgactcatctgcagaag

SEQ ID NO: 204007 - DNA, 601 bp, Human
atttaatttgggtctgggtgcagtggcccatgcctgtaatcctaacagtttgggaagacaaggcaggaggatcgcttgaagccaggagttcaagaccagcctgggtgacatagtatactttgtctctacacaaaataaaaattagttagccggccatggtggcatatgcctgtggtcccagttacttgggaggctgaggcaggaggatcgcttgagcctaggagtttgaggctgcagtgagctaagatcgtgccactgcactcaagcctgggtgaccctgtctcaatttttttttttttttgcaagggaatccctcatacaagaaggtaatgggatggggaaattcaggtcttcacttcgatttatttccagttccattgggaagagaagctgattaaatcaatgcttggaagagtacatctacatctcttactctaaaaattaactagcacctctcctttccttctaagaactaatgcatccatttaagcaaatgaagatcaatgttagcaatgcaatttgctgcaacagaaaaacgtacaaagattccttgagctacacaagaaaacaatcatttgtcttagcccctctaccaaccctg

SEQ ID NO: 204008 - DNA, 601 bp, Human
cagtgggagccaatgaggtcctcagaatgcggcaaactcctctgtgaaaatgtatccaggcaaatgtttactgaaaatctctagtaatttcaagagaaaacagagttgctctggaaaaaccccaatgcattatttaaaagccttctcttttttacctgtttatttatactcaatttacctagacccctcctatcaatcagcaaaccttcctcaggggaacaggtgcaaaatctgcttagtttcaagggcccagtagggttgtgaagttgaaagaaaattatttgagcctttctgtggaaaygagctagcctaatgagaagtgaggacttccaacaatgggggttgttctcagacaatggcattcagtccttttcaaacacaaagaggtgtttttgtcaaaaaagggaatttcccaagaaacctaagtttttctgtacaagcatttaggaactcaaagtggagagcagcccatgcaggatcctaataaactaaaattatcttttgtagaggaattcgaatgaactgtcatttaatggtagatgggaaatatttgggcatagtagaagaagaaaaataagacaaggagaaagggtcagaaaag

SEQ ID NO: 204009 - DNA, 601 bp, Human
aaatcctaactcccagggtgatagcagtaggagatggggtccttggagggttgactaggtcataaggacctcatgaatgagattagtattcttgtaaaagaggcctgagagagagtgcttcccccttctactatgaggacacagcaagaagacaccttctatgaaccataagtgggccctcaccagacaccaaatctgccttggacttcacagcctccagaatcatgagaaacaaatttttgttgtatataagctacacagtttatgatattttgttagggcagcctgaacagatgaagayatcaacttttcctaagtcataataatgtaaccaataacacccactaaagcttctaaagtactctttggatgaagcaatactttaatgtagagtcagtctactgcaggtgatcgaagaccttacgggacagatagggtaagagttattattatcttcatgttttagaaaaggaaagcaagtcttagagaggctcattgaccttttctacctacctacctcccttccttccttctttccttccttccttccttccttccttccttccttcttagtgtaacaatgttcctccctataactcac

SEQ ID NO: 204010 - DNA, 601 bp, Human
caaagtggatataaaaaggcttcacaaataccttcaactgaaccagcttggattttattgcagaggacctctccctcaccctgggctccccagggattgccaaccgtctattaatatgcaaaggctggtgtggcagaactcaaacactgaagccttagaaacaggaagctggaggaaaattaaatgcatttcattcccacagccgttttgattacataaccacacctgagccacaggcacacatcatttttacgtgatatcctaatcacacctgggggaggtattcaacatgtcttacctstgtcttagcccatcagtgttcttaaactcctctctctccatctctctctctttccttctttctgtgtctcactttcttcctcaaaagtttgtaacatggaatttaaacctaaatatcaaatggtttgactgttcatcaacgtgatatattagcatgatggagcggcagtccaagtgatagatccatcttcaacttgttgtgtgaccttgagcatatcacacatcctttgaaattgtttcttcatccataaaatatgggtattaaaaataagacttttctctatgcccagggggttgtgaa

SEQ ID NO: 204011 - DNA, 601 bp, Human
aatagctaaggcccaggacaaaagttgatattctgaagagaccttagacaaacgtaagactctgcaacaggcaggtatcagtgaagagaactaaaagtatggcaaggaggccaaaaagaataacaaggagccaatgaccatgaacctgcttactgccgaattctatcaagagctggttttgctggagaccaaagcttcaggtgctggaaataacatttccgtgatgtatgctgggaggtcaagaagcaaagtggatataaaaaggcttcacaaataccttcaactgaaccagcttggattwtattgcagaggacctctccctcaccctgggctccccagggattgccaaccgtctattaatatgcaaaggctggtgtggcagaactcaaacactgaagccttagaaacaggaagctggaggaaaattaaatgcatttcattcccacagccgttttgattacataaccacacctgagccacaggcacacatcatttttacgtgatatcctaatcacacctgggggaggtattcaacatgtcttacctgtgtcttagcccatcagtgttcttaaactcctctctctccatctctctctctttc

SEQ ID NO: 204012 - DNA, 601 bp, Human
ttcaagatgcgatttgggtggggacacaaagcctacccatattacccctcaactggtgaatcatggaaaattggagagataatagctaaggcccaggacaaaagttgatattctgaagagaccttagacaaacgtaagactctgcaacaggcaggtatcagtgaagagaactaaaagtatggcaaggaggccaaaaagaataacaaggagccaatgaccatgaacctgcttactgccgaattctatcaagagctggttttgctggagaccaaagcttcaggtgctggaaataacatttccrtgatgtatgctgggaggtcaagaagcaaagtggatataaaaaggcttcacaaataccttcaactgaaccagcttggattttattgcagaggacctctccctcaccctgggctccccagggattgccaaccgtctattaatatgcaaaggctggtgtggcagaactcaaacactgaagccttagaaacaggaagctggaggaaaattaaatgcatttcattcccacagccgttttgattacataaccacacctgagccacaggcacacatcatttttacgtgatatcctaatcacacctgg

SEQ ID NO: 204013 - DNA, 601 bp, Human
cagaactgtactgtatttggagatagacagcctctttaaagaggtgattaagttaaaacgaggtcattagggtggtccctaatctaatctgcgtggttggtgtccttattataaagtgttattaggacacacataaaagaaacaccaaggttatatgtacacagagaaaggccatgtgaagacccaggaagaaggcagccgtctgcagccaaggagagaggccacagaagaaaccaaatcttgaccttggacttctagcctccagaaccatgagaaaataaatgtctgctggccaagccayacagactgtggtattttgttttggtagccttggcaaactaatacaccagggaacaaatgagccatctttggattctcctaggaaggaggaagaacaggcaggaggcaggaagaggttggttcaagcagcaccatgggtggctcacaatagttcaccaagtatttttattgtaaactctgttcttttgaaagtatccccttctattagtctgttttcatactgctataaagaattccccgagactgggtaatttataaaggaaagaggtttaattgactcacagttcagcatggctggaga

SEQ ID NO: 204014 - DNA, 601 bp, Human
aggaattaaataagatcaacaaatgtaaagaacttaacgcagtgcttagaagataacagatattcaataaatattttgtttaatgcaaattatagaggagcacaaacaggagaaggaaagcttatgaccgaagaagttcctgcctgtcacaaagttttatttgcaggccaggcgcgatggttcatgcctgtaatcccagcactttgggaggccgaggtgggcagatcacctgaggtcaggaggtggagaccagcctggccaatatggtgaaaatctgtctctactaaaaatacaaaaaatyatagccaggcatggtggcaggcacctgtaatcccagctactcaggaagctgaggcaggaggattgcttgaacccgggagtcagaggttgcagtgagccaagattgcaccattgcactccagcctgtgtgacagagcgagattctgtctcaaaaaaaaaaaaaaagctttatttgcaaaattgtcacgaaagctaacatttattgaatgcttgctatgcgccaggctttatgccaccttacttcatgtctgacagcaagactaagaagtaggtgtcattatcaccattttatagatgaaga

SEQ ID NO: 204015 - DNA, 601 bp, Human
ataatatcagccttaaggcttatggtgaggaattaaataagatcaacaaatgtaaagaacttaacgcagtgcttagaagataacagatattcaataaatattttgtttaatgcaaattatagaggagcacaaacaggagaaggaaagcttatgaccgaagaagttcctgcctgtcacaaagttttatttgcaggccaggcgcgatggttcatgcctgtaatcccagcactttgggaggccgaggtgggcagatcacctgaggtcaggaggtggagaccagcctggccaatatggtgaaaayctgtctctactaaaaatacaaaaaattatagccaggcatggtggcaggcacctgtaatcccagctactcaggaagctgaggcaggaggattgcttgaacccgggagtcagaggttgcagtgagccaagattgcaccattgcactccagcctgtgtgacagagcgagattctgtctcaaaaaaaaaaaaaaagctttatttgcaaaattgtcacgaaagctaacatttattgaatgcttgctatgcgccaggctttatgccaccttacttcatgtctgacagcaagactaagaagtaggtg

SEQ ID NO: 204016 - DNA, 601 bp, Human
attctcaggattgtaaagttttgttagtaataatatcagccttaaggcttatggtgaggaattaaataagatcaacaaatgtaaagaacttaacgcagtgcttagaagataacagatattcaataaatattttgtttaatgcaaattatagaggagcacaaacaggagaaggaaagcttatgaccgaagaagttcctgcctgtcacaaagttttatttgcaggccaggcgcgatggttcatgcctgtaatcccagcactttgggaggccgaggtgggcagatcacctgaggtcaggaggtsgagaccagcctggccaatatggtgaaaatctgtctctactaaaaatacaaaaaattatagccaggcatggtggcaggcacctgtaatcccagctactcaggaagctgaggcaggaggattgcttgaacccgggagtcagaggttgcagtgagccaagattgcaccattgcactccagcctgtgtgacagagcgagattctgtctcaaaaaaaaaaaaaaagctttatttgcaaaattgtcacgaaagctaacatttattgaatgcttgctatgcgccaggctttatgccaccttacttca

SEQ ID NO: 204017 - DNA, 601 bp, Human
cattgataagactcttaaggaatgcaaaagttgattatataatttcacaacatgtagtgcttagcaatagtaaggaaactctatttaaattccaagatccagtaataactataggaaagtaggtactgcctcaaggaagagtaggctgctataattattgtattataattattagtttaacataagactttctcacggtattgtaagatctgacaggagtgtataatatctgtcttgttcaaggctaaattctcaggattgtaaagttttgttagtaataatatcagccttaaggcttatsgtgaggaattaaataagatcaacaaatgtaaagaacttaacgcagtgcttagaagataacagatattcaataaatattttgtttaatgcaaattatagaggagcacaaacaggagaaggaaagcttatgaccgaagaagttcctgcctgtcacaaagttttatttgcaggccaggcgcgatggttcatgcctgtaatcccagcactttgggaggccgaggtgggcagatcacctgaggtcaggaggtggagaccagcctggccaatatggtgaaaatctgtctctactaaaaatacaaaa

SEQ ID NO: 204018 - DNA, 601 bp, Human
aaacattcagtattcccgaatgctatataacttctgcaaaggggactagtatgacaattttatttcatgggaatgggggtagtgtataagcagtgagcagtgtttcaaaactggagcttcctttgaaagccctataaggcaattgggctcttttgaggatgcttatctctccatgagggtatgaaaattaaaagttggaggcacaatacctttgtaaagagctttatgactgacacttttaacagggtactgtggcagtgtttgtttcttcaaagtgctgatatgacttgcgggtaaatcrgctactttttcaagtctctttctgtcatcaaatgcttcctacaacttgtaggttaactcgactcatttctgcaatattgaacaaccaagaggaagccagcattacagtttatgattaaaataaagtgaaggtgtccaaaataatgttagctgtgcctaccagagctcatgctttaaagtagacttttccagttaatactcatgtttaaccagaaaagcagaaacctcactctgaggatgtgggttctgccttcttgagcatgaaaagtttcctttctgttcttcaggtaattatatcatt

SEQ ID NO: 204019 - DNA, 601 bp, Human
agactttaccagaactgccgctcctaaagccaccatgcacatgactgtggcatcaggtcaactgcaaacacagagcctgcgaaagcagttgtctcactcaacatacaacaggtgcactgataattctgccaacaacccgttagtgatgtcccacacataaatctcatttttataaatccaagtatctgttcaaccaaattaagtacccacctatcctatgccaggaacagttctaatgaaattttatttattttttatttttattatgattatttttttgagacagagtcttgctctgtcrcctaggctggagtgcagtggcacaaatctcagctcactgcaacgtcagcctcctgggttcaagtgattcttctgtctcagcctcccgagtagctgggatttcaggtgcacgccaccatgcccggctaatttttgcatttttagtatttttgtagagtattttgtatttttagtagagtagggtttcgccatgttggccaggctggtatcaaactcctgacctcaggtgatccaccctcctcggcctcccaaagtgctgggattacaggtatgagccactgtgccaggcccagttctaatg

SEQ ID NO: 204020 - DNA, 601 bp, Human
tgtgatttattttgtatttttcatttatttattattttttctttttttcctgagatagggtcttgctctgtcgctcagcctggagtgcagtggcacgatcttggctcactgcaacctccacctcccaggctcaagtgattctcccaccccagccttctgagtagctgggactacaggggtgtatttttgatagagatggggtttcaccacgggctggttttgaactcctgagctcaagtcatctgcccgcctctgctttccaaagtgctgggattacaggcatgagccactgtgtccggcygtgaagtattttttaaacaaaatatttattattttttctcctttttcaaaatttgttttatattcagggggtacacaggcaggcttgttacctgggtatattgtgtgacgctgaggtttgggatataaatgatcctgtcacccaggtactgagcatagtacccaacagttgatttctcaacccttgtccccactccctccctcccacggctagtagtccccattgtctattgttgccatctttatgtccaaaatcacccaatgtttagctcccgcttataagtgagaacatgcagcattt

SEQ ID NO: 204021 - DNA, 601 bp, Human
gctcactatctaacataaataacctatgtcataagactgtggagaaaattcccatatgcactttggggcagcccaatcctgagcatattagaccttccctggcaccccagatggtgaggctgtcctctccctccagctccctccttggcccctgtctgaaggcccagtatcctccctgttctcacacgagtctaatgtgggccagaaaggatagatttacgtgccttcagcacaatgcatggccagtgagtatcaagtcctcctgactctctggccctatgaccctattctgacaactgartcttttccgtatgcctcagatctgcctaccatctcctgttttcatctgccgcaaatgaatccaactccccagacaactattgaacattcaattactggctcaagtggacaactcaaattaccggctttccctttctgcctgacccagtgcaaagacctctatcctatactgacttatggcgagaagtattagagcttcacataagtgctatgaagagcattgatcagtatcttttgcaaacccacactgtaaaaatgtatcaagccaaatgttttctatgcagaggtgacttgcagaagt

SEQ ID NO: 204022 - DNA, 601 bp, Human
gtgaatccaggaagcacaaaccaggatgtagggaaagagagacagggaagacagaaaagccaacatggtgtgctggtgtctgctctactcactacacttactctcccagatttcacctttgctcacatcagtcctcatgccatggaatgaacctaacctttctgtctctcatgaagaattccacttacatgaatggcgggcaaggctcaaaaagcctcgccttcctatttgtaaaatgacttcaaactgtctacatagttcaattaaaattttatacttccttccaggattagaacacagyttccaaattctcttaaatgcctgggcagccatcaaaccttccagtgatcggtgatgcagtaaatacatgggttagggcaaaggggctggcagcaagatgaggaaaagctcactatctaacataaataacctatgtcataagactgtggagaaaattcccatatgcactttggggcagcccaatcctgagcatattagaccttccctggcaccccagatggtgaggctgtcctctccctccagctccctccttggcccctgtctgaaggcccagtatcctccctgttctcacacgagtcta

SEQ ID NO: 204023 - DNA, 601 bp, Human
tgggctctgaaaatattagaagtgggtctggttctgaccacacccccttcctcctaactgcttccggaaggggaagggaaataaggacttggggtggtttgacaggtgggaagtgagggtgttggggggctgagtaggaggtactttgctgctactgaaccaaacaaaaagtttagagaaagtaaaactaccaggaagaaatcaaaatagagtatgttttctctctgtggttccctataaactccaaatgttacaaacactaaggcaagagtgtcaattctacacacacacaaaaaggaargatgctgtctcttggcttgacttggtaggttcagagcgactgtgatactgtgactaggaaagtgtggtgaaggtcactgatcagcatctgcttcaaacccaaactctcactatctcagaagcaaacagcaaggtaaaagttttgtccaacagcagagggactgaatagagaaggaactcattaacctggtgtgatggctaatattgagtgtcaatttgatgggattgaaggatgcaaagtattgatcctgggtgtgtctgtgagggtgttgccaaagaaggttaacatttgagtcagtgg

SEQ ID NO: 204024 - DNA, 601 bp, Human
cacagctacaagcagtgagttccctctccttgaaggtgtcccatggaggatgaaagtcagcttggcggtgccttgcagaggaactaagcatcacactggtattcagtttagatgtccttgcttttctcttcaacctaaacttatcaaatttcatgatttaacatgggaaatagaagatttttttctagcagtattaggtggtttgggatctgcaaaataattcacatgagggcaaaggctaagactagaatcttggtctctctgaacagaaatttccttactggtctttcagcagttttcwtggattttagtactccagccaaatgagctactcctctctgcagaaatccttaagttccccagaagtgatccttttattcatagcacaaggccctttaacttgtcactgaatctctccttggctcatcacgctccaggcattcttgcagatcacttttcccttaagaaaggtggttcagacttcctctgcaaactaatcataggcttgtaggaggctgcccaggaaaatattaggcagactgattagaatgctcggattctgatcctcaggccactacggacctcactgataatggaaatg

SEQ ID NO: 204025 - DNA, 601 bp, Human
ttggggaggatgctagaggttaagatataggtctctgtttttagacacttgatgttcaggattttgatactaatgagaacttttagtaatcagaaatgtccacagctacaagcagtgagttccctctccttgaaggtgtcccatggaggatgaaagtcagcttggcggtgccttgcagaggaactaagcatcacactggtattcagtttagatgtccttgcttttctcttcaacctaaacttatcaaatttcatgatttaacatgggaaatagaagatttttttctagcagtattaggtgrtttgggatctgcaaaataattcacatgagggcaaaggctaagactagaatcttggtctctctgaacagaaatttccttactggtctttcagcagttttcatggattttagtactccagccaaatgagctactcctctctgcagaaatccttaagttccccagaagtgatccttttattcatagcacaaggccctttaacttgtcactgaatctctccttggctcatcacgctccaggcattcttgcagatcacttttcccttaagaaaggtggttcagacttcctctgcaaactaatcat

SEQ ID NO: 204026 - DNA, 601 bp, Human
tacacatcctccctcacttggggaggatgctagaggttaagatataggtctctgtttttagacacttgatgttcaggattttgatactaatgagaacttttagtaatcagaaatgtccacagctacaagcagtgagttccctctccttgaaggtgtcccatggaggatgaaagtcagcttggcggtgccttgcagaggaactaagcatcacactggtattcagtttagatgtccttgcttttctcttcaacctaaacttatcaaatttcatgatttaacatgggaaatagaagatttttttctagcagtattaggtggtttgggatctgcaaaataattcacatgagggcaaaggctaagactagaatcttggtctctctgaacagaaatttccttactggtctttcagcagttttcatggattttagtactccagccaaatgagctactcctctctgcagaaatccttaagttccccagaagtgatccttttattcatagcacaaggccctttaacttgtcactgaatctctccttggctcatcacgctccaggcattcttgcagatcacttttcccttaagaaaggtggttcagacttc

SEQ ID NO: 204027 - DNA, 601 bp, Human
ttgcaaatacacatcctccctcacttggggaggatgctagaggttaagatataggtctctgtttttagacacttgatgttcaggattttgatactaatgagaacttttagtaatcagaaatgtccacagctacaagcagtgagttccctctccttgaaggtgtcccatggaggatgaaagtcagcttggcggtgccttgcagaggaactaagcatcacactggtattcagtttagatgtccttgcttttctcttcaacctaaacttatcaaatttcatgatttaacatgggaaatagaagrtttttttctagcagtattaggtggtttgggatctgcaaaataattcacatgagggcaaaggctaagactagaatcttggtctctctgaacagaaatttccttactggtctttcagcagttttcatggattttagtactccagccaaatgagctactcctctctgcagaaatccttaagttccccagaagtgatccttttattcatagcacaaggccctttaacttgtcactgaatctctccttggctcatcacgctccaggcattcttgcagatcacttttcccttaagaaaggtggttc

SEQ ID NO: 204028 - DNA, 601 bp, Human
gaaatatacttcaaagtgttttcatgcattagtaacctgaaatttttatccctattgaaactattcacataataaaatgttattttcttcacacagccacacacaaaacaaaactgattccttagccaacattctaggcaaaatattctatttttgtgaaggtcaattcttgcagtatgacatctattccagcagctgactttgcaaatacacatcctccctcacttggggaggatgctagaggttaagatataggtctctgtttttagacacttgatgttcaggattttgatactaatgrgaacttttagtaatcagaaatgtccacagctacaagcagtgagttccctctccttgaaggtgtcccatggaggatgaaagtcagcttggcggtgccttgcagaggaactaagcatcacactggtattcagtttagatgtccttgcttttctcttcaacctaaacttatcaaatttcatgatttaacatgggaaatagaagatttttttctagcagtattaggtggtttgggatctgcaaaataattcacatgagggcaaaggctaagactagaatcttggtctctctgaacagaaatttc

SEQ ID NO: 204029 - DNA, 601 bp, Human
ttggcttgtgcaaaaaccaaaaaccaaaacaaaacaaaaccctactttttggtgttgtctgtggtagaacattgaaacccaggtattcactggcaggaaacaaaacgagagttttaacaagcctgggacaagtagcctgaaaaaatctcaaatcacttcatgattcattttgttgtttaaatggtgatatggttaactgaatctaggtatgaaacttaagtttcctccaggttgaaagtggacttgaagtatttcaatgtaaataacacctttaaatattacataatttaaaaaatcattaaaaaaaatctttatacactctaaattgtgttgccctaaggtaaagtatactccacatttcaaggcctcacagctccctgagatcaaagctctaggttagctaaatgggaaatcctggctgtgtgttacagatgaacactcttattatccattgtcctgggcctcctcgcttccctccatgcaagactgtttactgtgtaaacaaacagtagctgtgcaggccgtcaggtgttttgcaccaaagaattcaacatatttctccatgaaaaaatacaagtgttttactttctgtcagagtcta

SEQ ID NO: 204030 - DNA, 601 bp, Human
taaaggatatttaacacacattctgaaatgtgttaaaacgcaactcttcctgggtactgatatgaatctcaaaacaatcaccagaaaatattttagggcatattgacctgcacttggagaagaatccagaacaaaatctttttggcttgtgcaaaaaccaaaaaccaaaacaaaacaaaaccctactttttggtgttgtctgtggtagaacattgaaacccaggtattcactggcaggaaacaaaacgagagttttaacaagcctgggacaagtagcctgaaaaaatctcaaatcacttcrtgattcattttgttgtttaaatggtgatatggttaactgaatctaggtatgaaacttaagtttcctccaggttgaaagtggacttgaagtatttcaatgtaaataacacctttaaatattacataatttaaaaaatcattaaaaaaaatctttatacactctaaattgtgttgccctaaggtaaagtatactccacatttcaaggcctcacagctccctgagatcaaagctctaggttagctaaatgggaaatcctggctgtgtgttacagatgaacactcttattatccattgtcctgg

SEQ ID NO: 204031 - DNA, 601 bp, Human
aagcttttcctctttcccactgtgttgggaaagtctgccttttggaatcagatctgatttagaatcttttctccccaaagagccttgagatctggacaacttgctacagttctctaagcctgagatttcttctcttgaaaaagaagaaaataatactaaaagcatggggttgttgtgtatattttaccagatgatatatgtaaagtgtctggtatttaaaaaaaaaaaggtatgccataaatagtagttccctttaccctttctgcccaaggcaaacctcccagaagcaaactagagaacmaggacagagggagatagcaggtatgtaacaccctagagccattttcttatgttccaagttatccatatcctcactatcccccctccgtttccgcagacagcccaggggcaagcaaaagggcaaaaggcagacatcaaagctcaaaagggaaatagatgttgaactgaacagatgacttaaacccttcctcctattctaaaacactatctatgttccctgatctaatcttggagcagggaagaagggggcggaggttgtgggtgttgtgaagggaaaactcaaactaaacaacaggaagct

SEQ ID NO: 204032 - DNA, 601 bp, Human
accagagcttattagtgaattctaccaaatcgttaaagaacagctcattcaaatcttaatcaaactattccagagactagacacaaaaagagtctccccaaattattccacgaagctaatataactttaataacaaaagaagtcatggaaaatttttaaaaggaaaattgcccatccattttcctaaatataaacataaatcccaaatgccaaacaaaatgtcagtaaaccaagtccaacaatatatatagaagacagtagtacagcatgaccaagtttggactggtgaataatccaagaytgattcaatattagaaaatgtattattggcattcaatatattaacagataaaaggagaaaagtatatgactacttaagtgaggaaaatacattttatattttataaactttaatagacagttataggaaacaaaagaagcccttagtaaaccagaaatagaaggtaacttccttaacttcctaaagactatccactagaaataaaaccaaattgacatcaagcattctgaataaggaaatgctgtaagcatctccttgaaaatcaggatggaattaacaataccctcccattacccctct

SEQ ID NO: 204033 - DNA, 601 bp, Human
cgcttctgcactggattttcttcaagaggccaaacttagcttggccttgcttcatactctctcaggagagtaattcctaagaattacatcaggatgacagaggaaaggcctaagcaagctttaaggttctatcagagtcagaagaataaaacctcacaagatttaaggctaaacctctagaaggttcacttgaggcataccagtcaagatagttgggcctttgttgttttttaaaaaggtaggaaaggaatgatggtgagcatcagtgaatggatacaactctttcaataaataaacccayagaaaaatttaacaataaaaaggtaggcaaatcgaggttcatagagtttaaatatcttactgcaatagatattccaagcaccagacctggaatttgatcccacatcttataaatctaatttgaaaatccctttcaccataatcacagatgtaataatacatctacttcaagtaacatgaagacatgagctagattattgcagttaatgagcaatgaattgctactgatgctgggaaaatctatggatattggaaaaggggactaaattaataaacatactctgtgacaattacatcagaa

SEQ ID NO: 204034 - DNA, 601 bp, Human
ggatcacttgagctcagtaagttgaggctgcagtgagctatgatcatgccactgcactccagcctgtgcaaaagaacgagactttgtgtcaaaaaaaaaagagaaaaaacaaaaaacgtttaatctgcagtgttttcttttcatcatctcataaactgataaaatatcagtgtttgtgttttcataaagaaaaaagataagccagggtaaaaagaggctggaactaccgagatcttgctcatttgacatccagatattacaaagcagctggcccacactccttcaaagcctgaaggtggcratggctgaatctaatagatgaggtacataataggtgttggttttattacttcaacttactagatagcttctaggagggacacctaatgcttatgatgacaaaattgagattttaagagtttcacacaggcactaaataaaaagatgaaatataatagggataaagtagaaagttctgtcattgcatattcaaaataaaaatctctgtaacatgtaggacagggagaactgtgttaaaagctgttgataagaatacagattctagggattttcatggctatgattcccataagaaagtaat

SEQ ID NO: 204035 - DNA, 601 bp, Human
ctcctgacacctcaggcatgcctcccttaaacaccagctgtgctttgtagcagcttccactgatatcaacagcatcaggaccataaacatcgtgatgatggcttattccacgccaggcactgggctgatcagcttacaaatatttaaaagaacccttatatttatatgcaattgtttgcataataagtctttctagtaaaaccataaggtcctcaaagttgaatgactactttacaaactctggactccggagccagactatacagttcacatcccagctctgtcacctgccaactatgtragcttgggaaaatttccttacccttttgataccttcacttttccatgtgaaaaatgaggatgcatagccattcttacctcagagaattgttataaggttatgaggattaaatgacttaatacacacaaagggcttggaagagtgtttagtacatagaaagtactcattactgtcagaaaaaataaaaactcagggacatgcaattagcacaactgtctggctacaaaacatggaattgtgagcaaatgaacaacaaatagaatctccacaacatagtttctcatattttttaattttttt

SEQ ID NO: 204036 - DNA, 601 bp, Human
agaattggccctgggagtctgagacctggattacagttccagctctgccactaactagctctccagccctgggcaagtcacttcccttgcctggatctcattttcttcgcctgtcaaaggagggaaataaggtccctacccttcaaacattctctgattccttgggaagctgccttttctgacaacattaaaaaaagaatgtgttttacctcatcttgctacttatgtcatcaccaagaaatagccctgttcaaatgtgtgccacattctagacagaggccttaagcagatgtgtcttctsactttttaaccaaaacctacaggcacctgacaaataggaatataagcccacattgagattatgttctcaagttactttttcttaggtttggcagcattatctagaagaatcattattttcattcagttaccaatatttattttacttccattctgccagctgaatcctggcataaatacatctggaagggaagaagcatttgaaggatggccaaaatgttctgaagaagtcataggacgttcttggagaggggattgagttttaaaatgtggagttgagagtaaaataaactaggtatga

SEQ ID NO: 204037 - DNA, 601 bp, Human
aagttttcttaaaaataacaacaaacacaacaacaaaaaaagaatttccagattacaggaaggaaaaaaaattcattgctttagaggatgtaaacacaaatgtggagttttaaaaatgtgattaaggagaaaggggattagctggaggcaagaaacctgggtattcagacttctggtgaaatgttcaagctggggacaggttggtgacagtgggaattgccaacaaaatgcaatataagatttaccctcaatggcattttcccaggtcatcttagggaggaaagatgcagagagagatcaycaatattttcaaaaagaccaagaaatgatgaaagaggtactatgtttctcagaagttatagctaatgtctcgagaggctgaatgatgcagaggaaggagaattggccctgggagtctgagacctggattacagttccagctctgccactaactagctctccagccctgggcaagtcacttcccttgcctggatctcattttcttcgcctgtcaaaggagggaaataaggtccctacccttcaaacattctctgattccttgggaagctgccttttctgacaacattaaaaaaagaatgtg

SEQ ID NO: 204038 - DNA, 601 bp, Human
gtgcttaccggcagtaatttcaggcaaagagctgttgaaactgatttgaagcagccaggcccaggttcagggtgcctagtaatcagaactaattaataaaccatgtcctttttgggcatcatgatttaaaagctgtgctttagaaattaaaattccaatcttcagttgtaagaaaaggggcggagaggagtcagaggtgctcttcaaaccaataatccaccaagccactttcaatatgtttgtgtttttcatttgaaggacaggcagttgtgaatattccaaaagagcattcagtaaagtmcaaatttgctaaggctccaagttgccacaactaaatctttgttgggttggccagatgacatttgaaagaaaaagcacacaggctactaatgaggaaatgctttaggcaaatccaatcaactctcctaccagactggtttctaaggagccggaaagtccgtctgatgtgttcaagttttcttaaaaataacaacaaacacaacaacaaaaaaagaatttccagattacaggaaggaaaaaaaattcattgctttagaggatgtaaacacaaatgtggagttttaaaaatgtgattaaggag

SEQ ID NO: 204039 - DNA, 601 bp, Human
ctgcttacaacctgatatggtttgaatatttagcccctccaaatctcatgttgaaatgtaatctccattgttagaggtgggcctagtggaggtattggatcatgaggacagatccctcatgaatggcttagcgccatccccttggtaatgagtgagttctcacccagttggttcacttgagatctggttgtttaaaagagtctgggacctcccccttctctctccctttgtcccattcttgccatatgatgtgctgctctccctttgctttccaccatgagtaaaagctccctggggcatyaccagaagccaagcagatggtggcgccatgcttcctgtccagcctgcagcaccgtgagccaattaaacctctttcctttataaattacccaagcccaggtattcctttatagcgatgcaaaatggattaacacacaacccattggccagaacttactcacatggccacttctaggtggaaaataaattttttctttattcttgacagctctatgtccacctagctaaaaatggtagggagaggtggctattactggggaaaatgaagagaataaatatctggagacaacagaggaattct

SEQ ID NO: 204040 - DNA, 601 bp, Human
aggttctggtagtttttttcatatctatcctgagggagaataagtaacatccacacatccgttcttaaaatccctttgtccatccaggagtcctgattttttttgatatgtatagaaaatgaagaagtttgttattgtgtataataaaaaaaaaagcaaaagaagattgccattggatttcttcaagaacccataatttctggtacagaggaagtaataaaatggtcaagatggtccttcttgctggaagagactccaagtcatttttacaaggcttggctatcaattgtagacataattstactgccaagcactcctgtccccaatcaccagttgaggtctgagactaagcagccccaggcagggagtgaaagcagggtagccatgcttgggtgtggtaaagcagtggctctaattggaaatagagtgtgtgaaaacttcatggttctctgttcattagtgtcctgaaatttctatacctggcaatcaaaatagttaggatatcatctaattcagggaagggaaggtgttgcctaagaatagatttatctataataggcagccaacattagtgtattaagcaatacaggagtttgttatt

SEQ ID NO: 204041 - DNA, 601 bp, Human
tctgaatttgagcatttggtctttaggcagcttttgggttaacagggcaacgagattcttggaacatgcaatgtaaacttgcatattcttctctctatcacccacatactctggttcactgctgcctcaggagattgggctaagtccctcacaggtgtttgttattacaaatggcagtgaattggaatgagagccaactagggggcatttcctccagatctttgatgaatcggttccaccaactagtgccttccctgtgcaagacatcaacaggattatagagactacagagatgaacaayacactccaaactcagagttacaaaatcatgggtgactacagtgtatgctgttggtgtcccatctgggacccttttcctatagcctggttgctgtgtgttgggtgagaacaactcatagctgccccacaaatcttggcccaacagaagccgctaagctcaggaggctgcaaagtcactacccaatcccccagacagatgctctgcttctcagaaacccacctaagataggacataagacaaagtacacaaactacggcacaaagtagaatgagctatgttttataaaaggaataaaatacc

SEQ ID NO: 204042 - DNA, 601 bp, Human
ccaacattggggatcacatttcaacatgagatttggaggggacaaacatcctaactatatcacatggatttcctaatttagttctcacaaccaaacaaggcatctatttcaattattcccatcttagagatgacaaaactgaggttaagcggtttaagaaatgtggcctaagtcacatggactggtaatgagccctaaagacatttaggatgctgattccagttctttaactctttccagaaccagtgctcagtgtatagattctctctctcctctgtctctctctctctttcacacacasacacacacaattctcagcatggccctttcatgcttttctttggaagccatgatgtgttttcagaacatgagggcaatctcgtgaaagcccccatttagcctgagaggccgaggagctgcttgatacagtggagagttttgaccctatttacctgttctcagggtcggccaaggccatactccgagtgacgtagcacattttgagggggatgcttttccggtctctgtggaaggagaaggactgcgatgacggggggtctgaggtgctgccccctaaccgaggggattcaggcggaggtgt

SEQ ID NO: 204043 - DNA, 601 bp, Human
agattccccatttgctggctcgatccctcgctttctttatttctcttattttcctcctaaaatatatgttttctcttctactgaactaaagtaagaattctgggggatgagggaccctgaattttacttcctcttggctgcattccttataattgccatgggttgggtgatatatctagcctgtggcgtgcaaagtcatgtaccgactttgggaaacagcattccagacttggaccaaagccactccttttgctctcttgagcataaagagatgcttaaagtagaaaatagccttaaagcractctcatctaaccctccaagtatacagttgacagcactgaggcctagtaaggtgaatttgtttattactatctaacattaataagaaatattactattgcttatattcatggaaggttttcctgtactgagcaccttacatggtgcattgatttattttgtgttgctctaaaggaatacctgaggctaggtaatttaaggaaagaggtttatttggctcacggttctgcaagttgtacaggaagcatggcactggcatctgcttctgatgagggcttcagggagattccactcatggtg

SEQ ID NO: 204044 - DNA, 601 bp, Human
aaaacagagaacagggtgagagtggaccagctatgagctctgtgtccttcccagtctgtctgctcttacccctcttgccgatacttgctggctttcttgtacaactggccaatccctgtacagaaataactaatacaggaggagtagggagagcggggtagaaagatcctgcagctggccagagccagaagggccctggcagcgtccttagagtgagctaactgagatgagaacaaaaaagacattgagctgggagccaaggaagcaactttctccctgcccctattcccgatggcttttmcccatgagcaactctgagcctagccaaatactttctattcgggtgggttgcagctgtcccacacacattctaaataagggccagtcgagcggttcctatttttagcactttaatgtggatgcaaaggtcactaagattccccatttgctggctcgatccctcgctttctttatttctcttattttcctcctaaaatatatgttttctcttctactgaactaaagtaagaattctgggggatgagggaccctgaattttacttcctcttggctgcattccttataattgccatgggttggg

SEQ ID NO: 204045 - DNA, 601 bp, Human
agaaactggctttttaaatgtgaagtttttcagttattgaacatggcaactaattccaatttatttaaacacttagactatttaaaaaaaaacatatctgtaggctgggtataccataggctgccactttgcagtctgtggtctacattaattagcataatgcacatgataggcactcaatactacatcatgaattcatcacatctgaaaactttgacatcagatcattgggagatgggacttgtttgattgggtgggtaaaagcccagggaaaaggagacttagagtaaccaggatatcractgcaggcccaggaactctgcagaaattgtggggaacaaaacagagaacagggtgagagtggaccagctatgagctctgtgtccttcccagtctgtctgctcttacccctcttgccgatacttgctggctttcttgtacaactggccaatccctgtacagaaataactaatacaggaggagtagggagagcggggtagaaagatcctgcagctggccagagccagaagggccctggcagcgtccttagagtgagctaactgagatgagaacaaaaaagacattgagctgggagccaagg

SEQ ID NO: 204046 - DNA, 601 bp, Human
taatcgtcaatggtggacttgacgagcaccaatataaaagtttgaaacttattctcctctactggcttgatatacagactgaagtttccaatatctaaattaaggtctgatgtctcccaaaatattctttaaaatataattaaatgacctgggagtgctgttgtagcatataagtctacttctggaagaaacccaagaaatcatctattcaaattttctccctagtgtatgaattgctcctacaatgtctcagtaagcttttgtctcagtttagatttttctggaaatgattaactgacaytgtcacccattttataggcatgagtttgaagcccagctagactatataacagctatataatgttgagaacttacataaacactttttgtctaaattttttgtctgtagaatggggacaatgaaagaaactcagagagctgttaagaggactaagcagggttacaaattcaaagattaggcaggtaattaattgtattccatagtagaaggtaatagaaatgatgaggagagttcattcccttatcaaaggagaaaactctactgagctctggtatataactgccctgcctgcaacaatgt

SEQ ID NO: 204047 - DNA, 601 bp, Human
ctgccctgctggttctcacaccacagcagaacaggctctccctctcccacaggggaagccctatgtataatcgtcaatggtggacttgacgagcaccaatataaaagtttgaaacttattctcctctactggcttgatatacagactgaagtttccaatatctaaattaaggtctgatgtctcccaaaatattctttaaaatataattaaatgacctgggagtgctgttgtagcatataagtctacttctggaagaaacccaagaaatcatctattcaaattttctccctagtgtatgaaytgctcctacaatgtctcagtaagcttttgtctcagtttagatttttctggaaatgattaactgacactgtcacccattttataggcatgagtttgaagcccagctagactatataacagctatataatgttgagaacttacataaacactttttgtctaaattttttgtctgtagaatggggacaatgaaagaaactcagagagctgttaagaggactaagcagggttacaaattcaaagattaggcaggtaattaattgtattccatagtagaaggtaatagaaatgatgaggagagtt

SEQ ID NO: 204048 - DNA, 601 bp, Human
tgggacctgtctggacctgaagtcccttcggaaccatctggcttagctggattctcatgtttgattctgccctgctggttctcacaccacagcagaacaggctctccctctcccacaggggaagccctatgtataatcgtcaatggtggacttgacgagcaccaatataaaagtttgaaacttattctcctctactggcttgatatacagactgaagtttccaatatctaaattaaggtctgatgtctcccaaaatattctttaaaatataattaaatgacctgggagtgctgttgtagcrtataagtctacttctggaagaaacccaagaaatcatctattcaaattttctccctagtgtatgaattgctcctacaatgtctcagtaagcttttgtctcagtttagatttttctggaaatgattaactgacactgtcacccattttataggcatgagtttgaagcccagctagactatataacagctatataatgttgagaacttacataaacactttttgtctaaattttttgtctgtagaatggggacaatgaaagaaactcagagagctgttaagaggactaagcagggttacaaat

SEQ ID NO: 204049 - DNA, 601 bp, Human
ccttgtgctactttatggacattttaccttggacatttttcagcctgcattttaccttgtcttatatcaagatcaaaatcaatgctttctgttgttatttaatagtttgcatttaccttgtaagcttttgcccatccttgtatctttcaccttttaaaatcactctgttagatgtgtctcttgcattcagcatagagttgggttttgcagattccacatttctgatggtacaccataccctgctcagcctgtacctggagtttcataaaatatttgtttcctttttattttcttctcttcytctaccatgggcaagcctcacctaggcccccaatcttcttgttagaagcagtttgggacctgtctggacctgaagtcccttcggaaccatctggcttagctggattctcatgtttgattctgccctgctggttctcacaccacagcagaacaggctctccctctcccacaggggaagccctatgtataatcgtcaatggtggacttgacgagcaccaatataaaagtttgaaacttattctcctctactggcttgatatacagactgaagtttccaatatctaaattaaggtctgatgtc

SEQ ID NO: 204050 - DNA, 601 bp, Human
ttttgttattgattttctagttttattccactgtcatcagaggctgttgtttgtattatttgtacctaatggaacttattgcattttctttgtgacctgatctgtggttaattttgtcagtgttctttgtggacttgaaaagtaagtgtattctctattatcagagtaaagagttcgcaatgtattcagatctactttatttattttgttgtttgggtcttccatataattatagtaagtcgacccttacttatggttccactttccatggtttcagttatctgaggtcaactgcagcccaaaataagtacaataaaatattttgagagacagagagaccatattcatataacttttattacagtatattgttataattgttccattttattagtattgttgttaatctcttactgtgcctactttataaattaaactttatcatagtatgtatgtataggaaaaacacagttatagaggagtcagtactatccatggtttcaggcatctattgggggtcctgttacattccttctatgaataaggggggattactgtatttatctgtgtcctctacttgcccttacttggatggaaagtg

SEQ ID NO: 204051 - DNA, 601 bp, Human
gagttattttacagagagctttaaaaaacccatgaaaaaaaggctttgtgtggtttggttttgttattgattttctagttttattccactgtcatcagaggctgttgtttgtattatttgtacctaatggaacttattgcattttctttgtgacctgatctgtggttaattttgtcagtgttctttgtggacttgaaaagtaagtgtattctctattatcagagtaaagagttcgcaatgtattcagatctactttatttattttgttgtttgggtcttccatataattatagtaagtcgwcccttacttatggttccactttccatggtttcagttatctgaggtcaactgcagcccaaaataagtacaataaaatattttgagagacagagagaccatattcatataacttttattacagtatattgttataattgttccattttattagtattgttgttaatctcttactgtgcctactttataaattaaactttatcatagtatgtatgtataggaaaaacacagttatagaggagtcagtactatccatggtttcaggcatctattgggggtcctgttacattccttctatgaata

SEQ ID NO: 204052 - DNA, 601 bp, Human
attatttgacacagaaggtataacaagacattgatatctgagaagactgtttaccctgaggcttaaagggcaagtaggaagttgtcaggaaggcaattgtaggaagtatacaaattatttaagggatgctggaacagaaacgatgaggtaaagaggagctggacaattacggactatttaaagcctaaaggggtttttatgtaatactgaggagtttagatatgagtgcaggtgacagggagccattttgacagaaggagtaaatttcagattcccttggctagctaggtgtagagtagayggtgggaaatggggaaagagcaaaccagcaacaaaacaccctgtaagaaacatacccaaatactctcagggactaaggatgtgggcctggctcagggcagtggctgtgaaggcaaagagctgaatatgaaaaacaagagatatttaagaggtagaataataaaaatatattgtaattactgacagccactagcattgacatattcttgtggattcaatgcctgctgggtgacctttttcacagaaagagcagcaatcctgcctgctgttctatggctgttgtatttgagaaattgaacat

SEQ ID NO: 204053 - DNA, 601 bp, Human
ttctggcattctgctcatattcacatttgtcttccaatacagcctgctcacaatgagagggtatataaatcctcccacgtgggcatttccatctacttgacaactgtgttgctcatcataaacaaattttgcctatttggttaatgtgagtcaaccccttagagatggatctgctaacactatgcccactaaatcaagtttctgatcttctgtggctgaaactcaagcactggattgtggtgacatcactaagggtaccttgtagcaacatatccaggcatcttacaggacttaacagatsgcacctctctgaatcacagtgcagcctagcacaggttttccattagaaaccaagacagcactttctgtgaatgtttcatttgtgcaccattaatagagatgtacactgtttcccaagaaagatgatgtaaatctttccataatttaaccatgaaaatctacagtggactctgttacgtagcagtacagggtcatgacttaaagcctcataaactacccattgtagcacagctgctcacgatccagtgacacacttggttaatggattgtcctggtttctttaagcttcctatgtctgtca

SEQ ID NO: 204054 - DNA, 601 bp, Human
agaaccatgttaactgaagaggataaattagccatcaaagggcagggaagggccacatgggaaacctcaggctatttatgtacagctcaaaggagtgggagtgttggcaaagcagaaatttacataagggttacctcggcaaggctctccccatcctggaaaggagggttttcagcttacttgcctaaaacatatttcctaaggtctattagcacaccttctattgattccacactcaccaaatcactttcatgacaatttaatttcttgtgtagcttatctactcagaaagagtgcatcrctattctttgaaagtccacattgttttgggttattaatacttagtgttctggcattctgctcatattcacatttgtcttccaatacagcctgctcacaatgagagggtatataaatcctcccacgtgggcatttccatctacttgacaactgtgttgctcatcataaacaaattttgcctatttggttaatgtgagtcaaccccttagagatggatctgctaacactatgcccactaaatcaagtttctgatcttctgtggctgaaactcaagcactggattgtggtgacatcactaagg

SEQ ID NO: 204055 - DNA, 601 bp, Human
aactaaagtatttggaaacatctaaaactcaaaacagggtactatgagaacaacttcaaggagcctagaatgaaaagtgattaaatttgataagcaaaacccaaatccactgtttcgtactcacaggaagaaagaaccatgttaactgaagaggataaattagccatcaaagggcagggaagggccacatgggaaacctcaggctatttatgtacagctcaaaggagtgggagtgttggcaaagcagaaatttacataagggttacctcggcaaggctctccccatcctggaaaggagggytttcagcttacttgcctaaaacatatttcctaaggtctattagcacaccttctattgattccacactcaccaaatcactttcatgacaatttaatttcttgtgtagcttatctactcagaaagagtgcatcactattctttgaaagtccacattgttttgggttattaatacttagtgttctggcattctgctcatattcacatttgtcttccaatacagcctgctcacaatgagagggtatataaatcctcccacgtgggcatttccatctacttgacaactgtgttgctcatcataaa

SEQ ID NO: 204056 - DNA, 601 bp, Human
aaagtttaataaatttgagagttctatataaaacatgagggggcaataatgtacccccaaacactgggaaaaagaggagaaaggctgaactggtaaaatgattcctcccttgtttgtagccaccaaagaccatctgtctatgaatgtgtaactaaagtatttggaaacatctaaaactcaaaacagggtactatgagaacaacttcaaggagcctagaatgaaaagtgattaaatttgataagcaaaacccaaatccactgtttcgtactcacaggaagaaagaaccatgttaactgaagrggataaattagccatcaaagggcagggaagggccacatgggaaacctcaggctatttatgtacagctcaaaggagtgggagtgttggcaaagcagaaatttacataagggttacctcggcaaggctctccccatcctggaaaggagggttttcagcttacttgcctaaaacatatttcctaaggtctattagcacaccttctattgattccacactcaccaaatcactttcatgacaatttaatttcttgtgtagcttatctactcagaaagagtgcatcactattctttgaaagtccac

SEQ ID NO: 204057 - DNA, 601 bp, Human
agtttttttttttttttttttgagatggggactcgctctttcgcccaggccagactgcagtggcgctatctcggctcactgcaacctccgcctcctgggttcacgccattctcctgcctcagcctcccgagtagctgggactacaggcgcccgccactgcgcctggctaattttttgtatttttagtagagacggggtttcactgcgttagccaggatggtctcaatctcctgacctcgtgatccacccacctcggcctcccaaagtgctgggattacaggcgtgagccaccgcacccggsctgtttttagttttaaattgaatggtaaatgtttaacttcttatgttaaattacacttgaaaaaatagaatattgacttttgttgatgatatacacagccgattacaagcaattccactgctgtgtttcaggaggtttccagttccagcaaaacaatgatctacataaattcaggaatgcttctgccactgacacctgggttttctagataaagtataataagaaaaatgtgcttgtttgtgtaatgctgatcttacaagaaagaaaaggaaactcccaggtgtcaaaaaaagggggtgg

SEQ ID NO: 204058 - DNA, 601 bp, Human
gattagttctcacctaaatttctgcaacagcatcctagctagtctcccagcctctagtcttgcctcctattgatctatgcagccagagagatctttgctacatcactccatggcttcagacccctcctagaaaaaagttcaagttataaagtggcttagctctcatcatgatgacttctccagactcatctcttgagatattttttttttttgctttcttttgaattttaatgtttgtgggtacacagtaggtatagacacattcttcttatgaattgctccaaacaaactaaacctcccwttcttcaaggaactatagaactatattttttcttgccttagtgtctgtacttacactagttcctttgctgagaataccctccctgtcttcctatctcaacctttgacctggctaacacttactttattattcaagtctaagcatagacatcactccctgttgacaacacccagcctgctttaaaaacagaactttggatgcagtgtccttcctgcgaggaagactccatagcatcctgtactttcctcattgtctttctatgatattgtttgcttaattaccaacttacttgtagatatt

SEQ ID NO: 204059 - DNA, 601 bp, Human
caactcctgccaattctatctgtttaagtctttcaaatgtatctaactattcttcagaatcactgccctaaccttataaaagaagccaggattagttctcacctaaatttctgcaacagcatcctagctagtctcccagcctctagtcttgcctcctattgatctatgcagccagagagatctttgctacatcactccatggcttcagacccctcctagaaaaaagttcaagttataaagtggcttagctctcatcatgatgacttctccagactcatctcttgagatattttttttttttgctttcttttgaattttaatgtttgtgggtacacagtaggtatagacacattcttcttatgaattgctccaaacaaactaaacctccctttcttcaaggaactatagaactatattttttcttgccttagtgtctgtacttacactagttcctttgctgagaataccctccctgtcttcctatctcaacctttgacctggctaacacttactttattattcaagtctaagcatagacatcactccctgttgacaacacccagcctgctttaaaaacagaactttggatgcagtgtccttc

SEQ ID NO: 204060 - DNA, 601 bp, Human
ctttcttagtgattcaaggcctgtctctgtgttttctggagaaattaatctaaggatgctatttgcaaactgacctagttcttcaaactgtcagctactacagatgcaggattagacagaagtatataaaatcatgatgtggttttcgtttacccaaacggctgttttatacttttcaactgaaaatacgactttcccaggacttaataaaaccctctaaaaaattcttaacacatcttcatgatactgaaagaatcctttgataatcttagtagggctggattttttttttaagtgggarattggaggattttacatttgctaagtgtctagtatgtcccaggcattaggcagatgtcaacttatttaattctaaaaatagtatattcatagagatactatcatcctcatttcatatattcaaaaaattcaaagaagttaagtaaattgccaaaagtcacccagataataagtagaaaagatggtaatgaaatccaggttggcctggtctgaaagtcaattatcttttcaaggctgcacaacggatttggtaaaaaatattgatggagtgcttgagaaaatagctccaagaattctaact

SEQ ID NO: 204061 - DNA, 601 bp, Human
gagctatgatcatgccactgcactccagtctgggtgacagagtgagaccctatctcaaaaaaaaaaaaaaaaactttatacacagagataataatagatttgtaaaggctggaaacctgatgcatatggaagtcaacagaaccttgggattgctctggtatccacagaaatattttggtccaaatttccactctggctcatgcaccttgttttatttgtcactctccttttctacatatctgacagcaggccagagaactgtgccatataaatttattggaatatttctataaagccatayatggccttggaaagcttctacactttcttagtgattcaaggcctgtctctgtgttttctggagaaattaatctaaggatgctatttgcaaactgacctagttcttcaaactgtcagctactacagatgcaggattagacagaagtatataaaatcatgatgtggttttcgtttacccaaacggctgttttatacttttcaactgaaaatacgactttcccaggacttaataaaaccctctaaaaaattcttaacacatcttcatgatactgaaagaatcctttgataatcttagtagggc

SEQ ID NO: 204062 - DNA, 601 bp, Human
gtgcacctgcagtcccagctactcaggaggctgaagtgggagaatcgctggagcccaggaggtcaaggttgcagtgagctatgatcatgccactgcactccagtctgggtgacagagtgagaccctatctcaaaaaaaaaaaaaaaaactttatacacagagataataatagatttgtaaaggctggaaacctgatgcatatggaagtcaacagaaccttgggattgctctggtatccacagaaatattttggtccaaatttccactctggctcatgcaccttgttttatttgtcactctycttttctacatatctgacagcaggccagagaactgtgccatataaatttattggaatatttctataaagccatatatggccttggaaagcttctacactttcttagtgattcaaggcctgtctctgtgttttctggagaaattaatctaaggatgctatttgcaaactgacctagttcttcaaactgtcagctactacagatgcaggattagacagaagtatataaaatcatgatgtggttttcgtttacccaaacggctgttttatacttttcaactgaaaatacgactttcccaggac

SEQ ID NO: 204063 - DNA, 601 bp, Human
agctgaaaaaagctcaaaatggtgtacttctcaccctatgaaggattccaaaagaaaaggtggacagagcacaacagaaatagctggataactaggaaaaaaatgaccaaggtacatgttctaaattgctggtggcacaattaaaactaaacagctgggcatggtggctcacatctgtaatatcagcattttgggaggctgaggtaggagaattgcctgaggccaggagttcaagagcagcctgggcaacatagtgagaccctgtctctactacaaataatttcaaaaattagctgggcayggtgggttttgtgcacctgcagtcccagctactcaggaggctgaagtgggagaatcgctggagcccaggaggtcaaggttgcagtgagctatgatcatgccactgcactccagtctgggtgacagagtgagaccctatctcaaaaaaaaaaaaaaaaactttatacacagagataataatagatttgtaaaggctggaaacctgatgcatatggaagtcaacagaaccttgggattgctctggtatccacagaaatattttggtccaaatttccactctggctcatgcaccttgttttat

SEQ ID NO: 204064 - DNA, 601 bp, Human
agcaaacaaggctgctttactcatggagctggtgaggaagacagatgttactaaaaagaaaagataaaatgaaatgtgaaaccactacatggtaacagatataaggagttgaggcattgagactcaagttggcaaagctcatagcacacagttgctgaacagcaataggctgtgggtttcttatgggcctagtgatggggcaaggacgtcttcaatgcggtttgttttttttccttacattcttatagcatcatagtttatgaaatgctttaacacatattgcctcattggactttcacaycaatgctgtaatggcaagattggagaaaaaaagaaggttgagaattactgtagcagaagttaattcagatgaaaatatgacagaaagggtacagaagtgagggcaaaaagagaacaaagtgttttcaagtctctattctttatttttcaaaaattagcggccttgtctaaaaaaaatcctagtaattataagctaggaaggcagaaggaatgtcacaaacttacattctagcattttagctgtggcagaatttggttatgctacagttacacttagttttgctgaggcaaacagagacaa

SEQ ID NO: 204065 - DNA, 601 bp, Human
tgggaaaactgagaagctcatctctatttcctgggtcacccttgtgttccctttgctttatccactcatcagttcatccagccatctatccattccttcagggagtatttattcactgtctactctgagccagtcactgggttggacactgggagatggaatgaagagcaaaagcaaacaaggctgctttactcatggagctggtgaggaagacagatgttactaaaaagaaaagataaaatgaaatgtgaaaccactacatggtaacagatataaggagttgaggcattgagactcaagytggcaaagctcatagcacacagttgctgaacagcaataggctgtgggtttcttatgggcctagtgatggggcaaggacgtcttcaatgcggtttgttttttttccttacattcttatagcatcatagtttatgaaatgctttaacacatattgcctcattggactttcacaccaatgctgtaatggcaagattggagaaaaaaagaaggttgagaattactgtagcagaagttaattcagatgaaaatatgacagaaagggtacagaagtgagggcaaaaagagaacaaagtgttttcaa

SEQ ID NO: 204066 - DNA, 601 bp, Human
tgacctggcccatagcaacatgtagactgcaggaatgctgaatgggaaaactgagaagctcatctctatttcctgggtcacccttgtgttccctttgctttatccactcatcagttcatccagccatctatccattccttcagggagtatttattcactgtctactctgagccagtcactgggttggacactgggagatggaatgaagagcaaaagcaaacaaggctgctttactcatggagctggtgaggaagacagatgttactaaaaagaaaagataaaatgaaatgtgaaaccactrcatggtaacagatataaggagttgaggcattgagactcaagttggcaaagctcatagcacacagttgctgaacagcaataggctgtgggtttcttatgggcctagtgatggggcaaggacgtcttcaatgcggtttgttttttttccttacattcttatagcatcatagtttatgaaatgctttaacacatattgcctcattggactttcacaccaatgctgtaatggcaagattggagaaaaaaagaaggttgagaattactgtagcagaagttaattcagatgaaaatatgacagaaa

SEQ ID NO: 204067 - DNA, 601 bp, Human
gaagaaattctaaacatctgtttgacctggcccatagcaacatgtagactgcaggaatgctgaatgggaaaactgagaagctcatctctatttcctgggtcacccttgtgttccctttgctttatccactcatcagttcatccagccatctatccattccttcagggagtatttattcactgtctactctgagccagtcactgggttggacactgggagatggaatgaagagcaaaagcaaacaaggctgctttactcatggagctggtgaggaagacagatgttactaaaaagaaaagayaaaatgaaatgtgaaaccactacatggtaacagatataaggagttgaggcattgagactcaagttggcaaagctcatagcacacagttgctgaacagcaataggctgtgggtttcttatgggcctagtgatggggcaaggacgtcttcaatgcggtttgttttttttccttacattcttatagcatcatagtttatgaaatgctttaacacatattgcctcattggactttcacaccaatgctgtaatggcaagattggagaaaaaaagaaggttgagaattactgtagcagaagttaat

SEQ ID NO: 204068 - DNA, 601 bp, Human
caaggccaacccccatgccaacctctcctccccaacagcccctctggtttagaatttaagggtcttcaggacaagcagttctaagctgaaaggctgcaactgcaatttaaaatatctgccacatggaagtagggagtcgacctaagataatcttaaagctatgcaactcttacaagtaggcctacagaagtcacagttctggttatcgtgaaaaaaacaaatatgctgtacagtggccatagttggagaatattttccctcataagcagagcctcatgggtttggcaaactgttatactgrccgaggcaatcattgtaaaggagagtttttttcatttagggaccaggacttgggagttcttggggaatatccaaggcaccattaaaaaatcattgctgaagaaattctaaacatctgtttgacctggcccatagcaacatgtagactgcaggaatgctgaatgggaaaactgagaagctcatctctatttcctgggtcacccttgtgttccctttgctttatccactcatcagttcatccagccatctatccattccttcagggagtatttattcactgtctactctgagccagtcactg

SEQ ID NO: 204069 - DNA, 601 bp, Human
tcctgccttagcctcccgagtagctgggattacaagcatgcatcaccatgcccagttaatttttgtagttttagtagaggcagggtttcaccatgttggccaggctggtctcaagctcctgacctcaggtgatctgcccacctcagcttcccaatatgctgggattacaggcgtaagctgctgcaccaagctgatttcctgtgcttttaagccaccctctctgcttgggctatgatggacaacggagcagcaaaaactgtcagattcccagaagtgcctgtttcagggcctcttgctctaytatgactggttggcaccagggcctcctggatgggggagggacaatgtccctcccaaggccaacccccatgccaacctctcctccccaacagcccctctggtttagaatttaagggtcttcaggacaagcagttctaagctgaaaggctgcaactgcaatttaaaatatctgccacatggaagtagggagtcgacctaagataatcttaaagctatgcaactcttacaagtaggcctacagaagtcacagttctggttatcgtgaaaaaaacaaatatgctgtacagtggccatagttgga

SEQ ID NO: 204070 - DNA, 601 bp, Human
ttttctttcttttttttttttttgagaccaaatctcactctgtcgcccaggctggagtgtagtggtgtggtctcggctcactgcaacctccgtctcctgggttcaagcggttctcctgccttagcctcccgagtagctgggattacaagcatgcatcaccatgcccagttaatttttgtagttttagtagaggcagggtttcaccatgttggccaggctggtctcaagctcctgacctcaggtgatctgcccacctcagcttcccaatatgctgggattacaggcgtaagctgctgcaccmagctgatttcctgtgcttttaagccaccctctctgcttgggctatgatggacaacggagcagcaaaaactgtcagattcccagaagtgcctgtttcagggcctcttgctctactatgactggttggcaccagggcctcctggatgggggagggacaatgtccctcccaaggccaacccccatgccaacctctcctccccaacagcccctctggtttagaatttaagggtcttcaggacaagcagttctaagctgaaaggctgcaactgcaatttaaaatatctgccacatggaagtaggg

SEQ ID NO: 204071 - DNA, 601 bp, Human
aatcatgaaatattttaaagtgataccctagagcaacatgtaagttacttgggaccagaaatctgtatgtttcttgcactccaccaaagaaataaacaaatcacattaaagccattaaacattatggtcccattccaaagaatgactttcaaggtcaatcctgggggtgaggatgatttaactcactgatcagaatcttgtacaatgataataaaacctctgcaagatggcacagagctcctgaaagacaccaaagatcagaatcctctactagttaggataagaatggggaacacatttwtatctctagtttatgtccagaaatacactcaaaggcacgaagtgacttatttcacataactgagagagttaagtatcagagccattcaatccattcagtgtaatatttattgagaacgtattgtgtactaggaagtaaagacatagggaagaatcagatgccttcctgttgctgtcctgggacagtttgccatcaaatccattccttgcacttttcctgagtttggtcagttatcacagggggatgattccctgaggcttctgtgtcacatggcttctgccaaataggaggcactgaagg

SEQ ID NO: 204072 - DNA, 601 bp, Human
atgtaaccccatgtaagttgaggagcatctgtgttacttattgaaaatataaacgaataaatcatgaaatattttaaagtgataccctagagcaacatgtaagttacttgggaccagaaatctgtatgtttcttgcactccaccaaagaaataaacaaatcacattaaagccattaaacattatggtcccattccaaagaatgactttcaaggtcaatcctgggggtgaggatgatttaactcactgatcagaatcttgtacaatgataataaaacctctgcaagatggcacagagctccygaaagacaccaaagatcagaatcctctactagttaggataagaatggggaacacatttttatctctagtttatgtccagaaatacactcaaaggcacgaagtgacttatttcacataactgagagagttaagtatcagagccattcaatccattcagtgtaatatttattgagaacgtattgtgtactaggaagtaaagacatagggaagaatcagatgccttcctgttgctgtcctgggacagtttgccatcaaatccattccttgcacttttcctgagtttggtcagttatcacaggg

SEQ ID NO: 204073 - DNA, 601 bp, Human
tctagaaaactaatatacctgccatttggaagattggggaaataattactgtcttaaattgacattttaacataaaaagctggcaacagtattgcttctttgagaggagaaccaagtggcctggatgtaggacttaaagatagacttatttttcactgcaagtcctctgtaccttttgaatattaaaccaagtgcatgtacagatggtccccaacttatagtggttcgacttaggatttttcaacttatgatggtgcaaaagcaatgtgcattcagtagaaactgtacttcaagtacccgwacaacctccctgctttttcactttcagtacagcattcaataaattacatgagatattcaatactttattatgaaatagtctgtgttagatgattttgctcaactgtaggctaatgtaagtgttctgagcatgtttaatacaggctaagctaagctatgacgttcagtagggtaggtgtattaaatgcatttttgactcatgatgttgtcaacttatgatgggcttatcaggatgtaaccccatgtaagttgaggagcatctgtgttacttattgaaaatataaacgaataaatcatgaaa

SEQ ID NO: 204074 - DNA, 601 bp, Human
tctggggagaaatactttatgccgatgagctgttgctttctctgtttcatgctattactctattcccataaccataatagaaagttggctcaacttcagataggagaaaatgaagcttcaaacggctccaccttagaagctgaggggatgaatcaggctgggacaagggcataagactgatgacatcatggggttggactgcatacaaccatcaaccatctccatgggggctccagctttgagatgagcatttcataaaatgtttgaggcaattcattgacctttcatgagttggagcagytgacattttgcctggatctgagccagagtgggcgctattctaaatgagaaaacagttatcccatctgcactaaaggaactttttctgatcctttgttcaagctttatttccaaggcactgagtgaatttaattaatttcactagcaccatcccctccttagtaaattcctcacacatgtggattcactaacaaattgaatttcatctctagaaaataacaaaaaaaggacattcaactaaaggatgagagattagtttggtgaaagctcagtgatctattcaaaatgaaaatgcttgtta

SEQ ID NO: 204075 - DNA, 601 bp, Human
gaaattcaaactaaatgattttactaattctaattagccttagtaaaaagacttaggggcagaagttgaaactctggggagaaatactttatgccgatgagctgttgctttctctgtttcatgctattactctattcccataaccataatagaaagttggctcaacttcagataggagaaaatgaagcttcaaacggctccaccttagaagctgaggggatgaatcaggctgggacaagggcataagactgatgacatcatggggttggactgcatacaaccatcaaccatctccatgggrgctccagctttgagatgagcatttcataaaatgtttgaggcaattcattgacctttcatgagttggagcagttgacattttgcctggatctgagccagagtgggcgctattctaaatgagaaaacagttatcccatctgcactaaaggaactttttctgatcctttgttcaagctttatttccaaggcactgagtgaatttaattaatttcactagcaccatcccctccttagtaaattcctcacacatgtggattcactaacaaattgaatttcatctctagaaaataacaaaaaaagg

SEQ ID NO: 204076 - DNA, 601 bp, Human
gtcccaaagggtctctatattcctggcatcagtttacaaatacagataattggaagggaccaattatagggtctgtatattatccatgcttttagtactctctcctttcttctggcgcctgccaacatcaccactaattttgcatcaagaacagctggagaaaataagaaattcaaactaaatgattttactaattctaattagccttagtaaaaagacttaggggcagaagttgaaactctggggagaaatactttatgccgatgagctgttgctttctctgtttcatgctattactctrttcccataaccataatagaaagttggctcaacttcagataggagaaaatgaagcttcaaacggctccaccttagaagctgaggggatgaatcaggctgggacaagggcataagactgatgacatcatggggttggactgcatacaaccatcaaccatctccatgggggctccagctttgagatgagcatttcataaaatgtttgaggcaattcattgacctttcatgagttggagcagttgacattttgcctggatctgagccagagtgggcgctattctaaatgagaaaacagttatcc

SEQ ID NO: 204077 - DNA, 601 bp, Human
gtcttgctctgttacccaggctttgctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttgtttaggacacaaraagatacaggaggagaaaatttcccagagtcttagactaatatgcaagttaaaatgtgcatcacacctggttaattattttattttattttattttttgtagagctggggctcttgctttgttgcccaggctggtgtttggccttaagcaatcctctttccttggcctccaaagtgctgggattacaggagtgaacaactgcgtgtggccctggtaattttttcataggtgccaaacattgtgaattttaccttattgaaggttggatatttttatattcctaaaactattcatcagtgt

SEQ ID NO: 204078 - DNA, 601 bp, Human
tttaagagacagggtcttgctctgttacccaggctttgctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttktttaggacacaaaaagatacaggaggagaaaatttcccagagtcttagactaatatgcaagttaaaatgtgcatcacacctggttaattattttattttattttattttttgtagagctggggctcttgctttgttgcccaggctggtgtttggccttaagcaatcctctttccttggcctccaaagtgctgggattacaggagtgaacaactgcgtgtggccctggtaattttttcataggtgccaaacattgtgaattttaccttattgaaggttggatatttttatattcctaaaac

SEQ ID NO: 204079 - DNA, 601 bp, Human
attctctctctctctctctctcttctttttttttttttaagagacagggtcttgctctgttacccaggctttgctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccayatgtgaggaagaatagacaggactcaaacagtttgtttaggacacaaaaagatacaggaggagaaaatttcccagagtcttagactaatatgcaagttaaaatgtgcatcacacctggttaattattttattttattttattttttgtagagctggggctcttgctttgttgcccaggctggtgtttggccttaagcaatcctctttccttggcctccaaagtgctgggattacaggagtgaacaactgcgtgtggccctggtaattttttcataggtgccaaacattgtgaattttacc

SEQ ID NO: 204080 - DNA, 601 bp, Human
atccacacattgtagtttcatattcagaagtttgatattaatttttttttaaatttcatgtttttacttaactttttgatcataaggaataccattatattaactatttaaaggtccatgttggataattctaacatccatgtcagttctgggtcagtttcaattgatcagtttttctctacatcatgggtcagatttgctccttctttgcatgtttggtaattctctctctctctctctctcttctttttttttttttaagagacagggtcttgctctgttacccaggctttgctgcagyggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttgtttaggacacaaaaagatacaggaggagaaaatttcccagagtc

SEQ ID NO: 204081 - DNA, 601 bp, Human
ttttccatccacacattgtagtttcatattcagaagtttgatattaatttttttttaaatttcatgtttttacttaactttttgatcataaggaataccattatattaactatttaaaggtccatgttggataattctaacatccatgtcagttctgggtcagtttcaattgatcagtttttctctacatcatgggtcagatttgctccttctttgcatgtttggtaattctctctctctctctctctcttctttttttttttttaagagacagggtcttgctctgttacccaggctttgatgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttgtttaggacacaaaaagatacaggaggagaaaatttccc

SEQ ID NO: 204082 - DNA, 601 bp, Human
gttttccatccacacattgtagtttcatattcagaagtttgatattaatttttttttaaatttcatgtttttacttaactttttgatcataaggaataccattatattaactatttaaaggtccatgttggataattctaacatccatgtcagttctgggtcagtttcaattgatcagtttttctctacatcatgggtcagatttgctccttctttgcatgtttggtaattctctctctctctctctctcttctttttttttttttaagagacagggtcttgctctgttacccaggctttsctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttgtttaggacacaaaaagatacaggaggagaaaatttcc

SEQ ID NO: 204083 - DNA, 601 bp, Human
atgttttccatccacacattgtagtttcatattcagaagtttgatattaatttttttttaaatttcatgtttttacttaactttttgatcataaggaataccattatattaactatttaaaggtccatgttggataattctaacatccatgtcagttctgggtcagtttcaattgatcagtttttctctacatcatgggtcagatttgctccttctttgcatgtttggtaattctctctctctctctctctcttctttttttttttttaagagacagggtcttgctctgttacccaggctgtgctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttgtttaggacacaaaaagatacaggaggagaaaattt

SEQ ID NO: 204084 - DNA, 601 bp, Human
tatgttttccatccacacattgtagtttcatattcagaagtttgatattaatttttttttaaatttcatgtttttacttaactttttgatcataaggaataccattatattaactatttaaaggtccatgttggataattctaacatccatgtcagttctgggtcagtttcaattgatcagtttttctctacatcatgggtcagatttgctccttctttgcatgtttggtaattctctctctctctctctctcttctttttttttttttaagagacagggtcttgctctgttacccaggcattgctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactcaaacagtttgtttaggacacaaaaagatacaggaggagaaaatt

SEQ ID NO: 204085 - DNA, 601 bp, Human
atagtttctattactaggtattttttgctatgaatgccatttggtatgttttccatccacacattgtagtttcatattcagaagtttgatattaatttttttttaaatttcatgtttttacttaactttttgatcataaggaataccattatattaactatttaaaggtccatgttggataattctaacatccatgtcagttctgggtcagtttcaattgatcagtttttctctacatcatgggtcagatttgctccttctttgcatgtttggtaattctctctctctctctctctcttctttttttttttttaagagacagggtcttgctctgttacccaggctttgctgcagtggcaccatcatagttcactgcagcctcaagcctctgggctcaagcagttctcctacttcagccttctaagtagctggtactacagctggctctagtgtgccaccacactacagctcacacaggtgaaagctggcccctggctgcccctcccctgcccagtaatgtacctgcctcaatggttttgtggtcgtggaaatggagagaagtgtttggaaatccacatgtgaggaagaatagacaggactc

SEQ ID NO: 204086 - DNA, 601 bp, Human
gtaagtaatccattacgtggatacagcactgtttgtttattcacccttcgatgggaaagtgggttgtttctagtttttggttatagtaatagcagcaaataatgctgctatgaacatttatggttttgtatagacacataatttcatttctcttgggttgatagctaggagaggaattgctggctcatatggtaggtgtgcctttaacattttaaggaatagccaaactgtatcagagtgactgtaccatttttcattttcaaactgaagtatatgaaggtctgagttcttccacatcctygccaatacctaatatagtgatcatttttaattttagctagattcatatgaatgtagcagtatctcactgtggttttaatttgcatgtgtgcattgactaatgaagtagatcaccttttcctgtgcttattttctatgcatctatcttctaagatcaagtgtctgtatacatttttgtccttttaaaaattgcattgattgcctttttattataaatttagagattttttaaatatatagactcttggctgggcatggtggcttacacctgtaatcccagtgctttgggaggccgaggtgg

SEQ ID NO: 204087 - DNA, 601 bp, Human
ctttattgaggcataattgatatgcaataaattggacatactttaagtgcacaataattttagacatacataccccccatgacagtcctttctccatttctctcattataagattagtttgcattttctagaattttaataaataaaatcatacagtatgtcttccttttgtctggcttatttcacacagcataattgttttaagattcatccatgttgtagcatgtatcaatagttcatttgttttatgggtaagtaatccattacgtggatacagcactgtttgtttattcacccttcratgggaaagtgggttgtttctagtttttggttatagtaatagcagcaaataatgctgctatgaacatttatggttttgtatagacacataatttcatttctcttgggttgatagctaggagaggaattgctggctcatatggtaggtgtgcctttaacattttaaggaatagccaaactgtatcagagtgactgtaccatttttcattttcaaactgaagtatatgaaggtctgagttcttccacatccttgccaatacctaatatagtgatcatttttaattttagctagattcatatg

SEQ ID NO: 204088 - DNA, 601 bp, Human
tggaggcaattttaactttttaaatcattttccagagagctggtcctaaatttgtgactagtagctctttctgtattttaaacactcactgtactttgtagatatttcactgtcaaggtctttatggaaatgacagcttcataattattttctctgtggaagcctttgctcaaagacactttcacctcttttgtagatagcaataatcattttcattacctgactgatttaaacaagcacaaacaaataaatcagctacccacaaaattgctatttaaaaaaatctatatctaaactatckagacaagttttaaattgtcatgcaattctgcaaagaaggacaaaaatcagaataatgcaaatgttcaactcaagttttaaaaggtcacactacatgaaattcaatctttctcatcttatagtaaatgccaaggtgccagacaagttgggaagaaagtcagtctctctgtgaggcagcaaaactatggggttagacttgttttgtttcgacttcattagttcctgttttttaagataatgtgtattaaaatagtagaacagaaaaattgttacagatgaaagaaattaacccaaaactttc

SEQ ID NO: 204089 - DNA, 601 bp, Human
tgctcaaggcagggttgtcacaaaccttcaatttgttaaaaaaaaaaaagagtatgtgcaaagtacaataaagcaaagtgcaacacaatgaagtatgcatgtacagaggaaaagcagaaaccaaagttatcctagttaaatgcatgaatgaatgaatgaccaaagacaattaataaactaaaaggaatttcgaggccatttaaacaaatcactcatttcacaagtgaaaagcctaacttccagagaagagaaattatttgcccaaggtcacacttgcaggtactattattgagcctagagyccagatttctttttttaattatttttgatttttattttactttaagttctaggatacatgtgctgaacatacaggtttgttgcataggtatacatgtgccatggttgtttgctgcacctatcaacccgtcatctaggttttaagccccacgtgcattaggtatgtgtcctaatgttctccctcccctttccccacaacgccccataggtcatggtatgtgatgtccccctccctgtgtccatgtgatctcattgttcaactcccacttatgagtgagaacatgcagtgtttggttttctg

SEQ ID NO: 204090 - DNA, 601 bp, Human
agagatgggagcaagggaagaacagccaatcgatggagccgacaggatacatacaacatttatgcattcagttatctgacttacatgggtgtagtttgtggtatcctaaaacaattacaacagtaacatcaaagttaccggtcacagatcaccataatagatacaaaataatgagaatgtatgaattactgtgagaattacaaaaatgtggcacagagatacaaagtgtgcacaatgtgttggaaaaatggtgcctggagacttgctcaaggcagggttgtcacaaaccttcaatttgttaaaaaaaaaaaagagtatgtgcaaagtacaataaagcaaagtgcaacacaatgaagtatgcatgtacagaggaaaagcagaaaccaaagttatcctagttaaatgcatgaatgaatgaatgaccaaagacaattaataaactaaaaggaatttcgaggccatttaaacaaatcactcatttcacaagtgaaaagcctaacttccagagaagagaaattatttgcccaaggtcacacttgcaggtactattattgagcctagagcccagatttctttttttaattatttttgatttttattt

SEQ ID NO: 204091 - DNA, 601 bp, Human
tgaacacttagaaaccttcaaagaggtattcactggcctaatttcaagattgttatgtcacagggaacacggagacctgaggagagggagagagatgggagcaagggaagaacagccaatcgatggagccgacaggatacatacaacatttatgcattcagttatctgacttacatgggtgtagtttgtggtatcctaaaacaattacaacagtaacatcaaagttaccggtcacagatcaccataatagatacaaaataatgagaatgtatgaattactgtgagaattacaaaaatgtgrcacagagatacaaagtgtgcacaatgtgttggaaaaatggtgcctggagacttgctcaaggcagggttgtcacaaaccttcaatttgttaaaaaaaaaaaagagtatgtgcaaagtacaataaagcaaagtgcaacacaatgaagtatgcatgtacagaggaaaagcagaaaccaaagttatcctagttaaatgcatgaatgaatgaatgaccaaagacaattaataaactaaaaggaatttcgaggccatttaaacaaatcactcatttcacaagtgaaaagcctaacttccagagaag

SEQ ID NO: 204092 - DNA, 601 bp, Human
tcctaagtagctgggactataggcgcacgccaccatgtctggttaatttttgtatttttagtagagacagggtttcaccatgttgggcaggctggtctcaaactcctgaactcaagcaatccacctgcttcggcctcccaaagtgttgagattacaggtgtgagccatcgtgcctggctagtttatgtaatattctaaatcctttcttgtcatgtcaccaattttacaacatcttcaccaggaatagattccatctcaagaagccactttttttttgctcatccataagaaacgacgcctscatttgttcaagttttatcatgggattgcaaaaattcggtcacatcttcaggtcccacttataattttagttctcttgctatttctaccacatctgcaattacttctttcattgaagtcttcagagttacccatgagggttggaatcaacttccaaacacccattaacattgatattttgacctcctcccataaatcacacatgtttttaatgatatttaggatggtatatcctttccagaaggttgttaatttactttgctcagatccatcacaggaattactatctatggcagctata

SEQ ID NO: 204093 - DNA, 601 bp, Human
ctcactctgtctcccaggctggattacagtggccctatcttggctcactgcaacctccaccccctgggtttaagtgattctcctgccttagcctcctaagtagctgggactataggcgcacgccaccatgtctggttaatttttgtatttttagtagagacagggtttcaccatgttgggcaggctggtctcaaactcctgaactcaagcaatccacctgcttcggcctcccaaagtgttgagattacaggtgtgagccatcgtgcctggctagtttatgtaatattctaaatcctttctygtcatgtcaccaattttacaacatcttcaccaggaatagattccatctcaagaagccactttttttttgctcatccataagaaacgacgcctgcatttgttcaagttttatcatgggattgcaaaaattcggtcacatcttcaggtcccacttataattttagttctcttgctatttctaccacatctgcaattacttctttcattgaagtcttcagagttacccatgagggttggaatcaacttccaaacacccattaacattgatattttgacctcctcccataaatcacacatgttt

SEQ ID NO: 204094 - DNA, 601 bp, Human
tttttttttcttttcctgagacaaagtctcactctgtctcccaggctggattacagtggccctatcttggctcactgcaacctccaccccctgggtttaagtgattctcctgccttagcctcctaagtagctgggactataggcgcacgccaccatgtctggttaatttttgtatttttagtagagacagggtttcaccatgttgggcaggctggtctcaaactcctgaactcaagcaatccacctgcttcggcctcccaaagtgttgagattacaggtgtgagccatcgtgcctggctaktttatgtaatattctaaatcctttcttgtcatgtcaccaattttacaacatcttcaccaggaatagattccatctcaagaagccactttttttttgctcatccataagaaacgacgcctgcatttgttcaagttttatcatgggattgcaaaaattcggtcacatcttcaggtcccacttataattttagttctcttgctatttctaccacatctgcaattacttctttcattgaagtcttcagagttacccatgagggttggaatcaacttccaaacacccattaacattgatattttg

SEQ ID NO: 204095 - DNA, 601 bp, Human
atattctttttttttttcttttcctgagacaaagtctcactctgtctcccaggctggattacagtggccctatcttggctcactgcaacctccaccccctgggtttaagtgattctcctgccttagcctcctaagtagctgggactataggcgcacgccaccatgtctggttaatttttgtatttttagtagagacagggtttcaccatgttgggcaggctggtctcaaactcctgaactcaagcaatccacctgcttcggcctcccaaagtgttgagattacaggtgtgagccatcgtgsctggctagtttatgtaatattctaaatcctttcttgtcatgtcaccaattttacaacatcttcaccaggaatagattccatctcaagaagccactttttttttgctcatccataagaaacgacgcctgcatttgttcaagttttatcatgggattgcaaaaattcggtcacatcttcaggtcccacttataattttagttctcttgctatttctaccacatctgcaattacttctttcattgaagtcttcagagttacccatgagggttggaatcaacttccaaacacccattaacattg

SEQ ID NO: 204096 - DNA, 601 bp, Human
agccttgagcgagttgtaatctttttgctggtggagggccttgcctcaatgctgatggctgctgactgatcagggtggtgggttttgaaggctggcgtggctgtgtcattttcttaaaataagacaaggaagtctgccacatcaattgactcttcttttcgcaaaatatttctttgcagcatgtgatgctatttgatagcattttactgtctgcagaacttttatcaaaattggagtcaatcctctcaaatcttgctgctgctttatcaacaaagtttatgtgatattctttttttttttyttttcctgagacaaagtctcactctgtctcccaggctggattacagtggccctatcttggctcactgcaacctccaccccctgggtttaagtgattctcctgccttagcctcctaagtagctgggactataggcgcacgccaccatgtctggttaatttttgtatttttagtagagacagggtttcaccatgttgggcaggctggtctcaaactcctgaactcaagcaatccacctgcttcggcctcccaaagtgttgagattacaggtgtgagccatcgtgcctggctagtttatgtaa

SEQ ID NO: 204097 - DNA, 601 bp, Human
cagtagctgccacccagcagagaagagggccaagagagtatgctgaagaggagatagaagctggatgggacaggaaggatttaaagagaatctatcacataaagggactagagagtagccagggaatttgggttcaggaagtaggaaacaccataggcaatttagttagtacaggagaactagatacagacataactcagagatatcatgggttcagttccagaccaccacaataaagtaaatatgaccatacagtgaatatcacaataaaatgagtctcaggaatttttttggtttcccrgtgcatgtaagagttatgtttatatcatactgcagtctattaagcatgcaatggcaatatatctaagaaaacaatgtacacactttaacttaaaaatactttaatgctaaaaattgctaatgatcatctgagccttgagcgagttgtaatctttttgctggtggagggccttgcctcaatgctgatggctgctgactgatcagggtggtgggttttgaaggctggcgtggctgtgtcattttcttaaaataagacaaggaagtctgccacatcaattgactcttcttttcgcaaaatatt

SEQ ID NO: 204098 - DNA, 601 bp, Human
caagctattagtatccaagaacctgttaacaggaactatcagtagctgccacccagcagagaagagggccaagagagtatgctgaagaggagatagaagctggatgggacaggaaggatttaaagagaatctatcacataaagggactagagagtagccagggaatttgggttcaggaagtaggaaacaccataggcaatttagttagtacaggagaactagatacagacataactcagagatatcatgggttcagttccagaccaccacaataaagtaaatatgaccatacagtgaataycacaataaaatgagtctcaggaatttttttggtttcccggtgcatgtaagagttatgtttatatcatactgcagtctattaagcatgcaatggcaatatatctaagaaaacaatgtacacactttaacttaaaaatactttaatgctaaaaattgctaatgatcatctgagccttgagcgagttgtaatctttttgctggtggagggccttgcctcaatgctgatggctgctgactgatcagggtggtgggttttgaaggctggcgtggctgtgtcattttcttaaaataagacaaggaa

SEQ ID NO: 204099 - DNA, 601 bp, Human
aaggtatagaaaataaaactgacaggatgttatgatagataaactgtgaggtggcagggaagagagaagtgtcaaggtgatgcctaggttttgagcttagacaactaaattaatgacagtgctatttactacgataaaaaactgaaaatgattcagagttggaaagaaacattgtgagtttggttaaatatctccattttcatttggatgtcttgttacaatctcagacttatagtatatacatgtacaagctactcttcaagagtctgtttatcctatggttattttgttttaatgcaaycaatatctttccaataattgaagttggatgacccaacatccttgatgcctcttgtcctcttctctaggccccagtgtacaattttatcagtattatcttggcagtatctccctttcagaagagctagccagactgcaagttaccaagttttctcagtggagttggggcaatcactaacctaggatgagatgtaagttttattttctaggccaactttgattaaatggtagcggttgcctgaaatgatgtcttgaaaggaatctgaggcctcattccaggctcatctaggataaatgtcat

SEQ ID NO: 204100 - DNA, 601 bp, Human
agataaacacggaataattttttagcattagtatgtcccatgtaatatctagtggtggagatggcataaagtacatgagttagaaaaaggtatagaaaataaaactgacaggatgttatgatagataaactgtgaggtggcagggaagagagaagtgtcaaggtgatgcctaggttttgagcttagacaactaaattaatgacagtgctatttactacgataaaaaactgaaaatgattcagagttggaaagaaacattgtgagtttggttaaatatctccattttcatttggatgtcttkttacaatctcagacttatagtatatacatgtacaagctactcttcaagagtctgtttatcctatggttattttgttttaatgcaatcaatatctttccaataattgaagttggatgacccaacatccttgatgcctcttgtcctcttctctaggccccagtgtacaattttatcagtattatcttggcagtatctccctttcagaagagctagccagactgcaagttaccaagttttctcagtggagttggggcaatcactaacctaggatgagatgtaagttttattttctaggccaac

SEQ ID NO: 204101 - DNA, 601 bp, Human
tattttgttttctcactatgcatatcatctatacctcccaaaatattctgtggttttatcttgctcagctgatttaaaaaaataataaggcatctaaatagacaaggtgctatgcagggcaaataaatgtgcatttgtcttataatcttagtacttacattgataaataatctatcccacagcccaatctagatcatagcatttagagtctgagggcctatttttgcttcttttgaattagattattttaaactagggttgccagagttagcaaataaaaatgtttgatgcccagttaaamttgagtttcagataaacacggaataattttttagcattagtatgtcccatgtaatatctagtggtggagatggcataaagtacatgagttagaaaaaggtatagaaaataaaactgacaggatgttatgatagataaactgtgaggtggcagggaagagagaagtgtcaaggtgatgcctaggttttgagcttagacaactaaattaatgacagtgctatttactacgataaaaaactgaaaatgattcagagttggaaagaaacattgtgagtttggttaaatatctccattttcattt

SEQ ID NO: 204102 - DNA, 601 bp, Human
tggagctattttcagcaggccagtcttttataactcctattttgttccccagttgaactgaccactgcttgatgaattgtgtttatctgtagttcagcgataaagttctcttttaattccctgctgaatagaaatatttagggcaatgccacagctgtgtttattctcaccctccaccacagttatgtaaatactgcctatggaactatttctgataacagcccatcccaaccccaaggaattatacgctcactctcaatgtctgccaagatgagccgtttcgatccagcttggcacggcrtatgaatgatatcacagcttctcagagatcatttggcaaaactcacaataaaagagtaattttcttcccctcttgctctctcaaaggctttcatggagccaagtgatatttcccagcatcctctacttcctctgtttagaaacatgaggctaatacataaaacttgaagcctcctactacgaaattaataaataaaacaaaactcacaacctgacaacaaaagtttcaagtgacctttcccctccaagtgactctggagaaaacacagatgaaactagtcaggaggatgaagtcttgctg

SEQ ID NO: 204103 - DNA, 601 bp, Human
gggagggagggagtaaagcagcaataaagtcaggatggctgattggagctattttcagcaggccagtcttttataactcctattttgttccccagttgaactgaccactgcttgatgaattgtgtttatctgtagttcagcgataaagttctcttttaattccctgctgaatagaaatatttagggcaatgccacagctgtgtttattctcaccctccaccacagttatgtaaatactgcctatggaactatttctgataacagcccatcccaaccccaaggaattatacgctcactctcratgtctgccaagatgagccgtttcgatccagcttggcacggcgtatgaatgatatcacagcttctcagagatcatttggcaaaactcacaataaaagagtaattttcttcccctcttgctctctcaaaggctttcatggagccaagtgatatttcccagcatcctctacttcctctgtttagaaacatgaggctaatacataaaacttgaagcctcctactacgaaattaataaataaaacaaaactcacaacctgacaacaaaagtttcaagtgacctttcccctccaagtgactctgg

SEQ ID NO: 204104 - DNA, 601 bp, Human
tgctgacattttgattgcagacttctggtctacaaagctgagcgaggataaatttctactgttttaagccacccagtttgtggtactttgttatgccaatcctagaaaactattacacaaatacatcatgtaactatcttcctgggtatagcagaaccaggactgcactactatttaaaatatatgggcgcttaaagatattcataagatgaatttagatcatttagagctgtggaatcatgtgtccattttagctcactttggagttaaaaagttgtcttcttagggccgggtgctgtgkctcacgcctgtaatcccagcactttgggaggccgaggcgggcggatcacaaggtcaggagatcgagaccatcctggctaacacggtgaaaccccgtctctactaaaaatacaaaaaattagccgggcgttgtggtgggtgcctgtagtcccagctactcggggggtctgaggcaggagaatggcgtgaacccggaaagcggagcttgcagtgagcccagatggcgccactgcactccagcctgggagacagagcgagactctgcctcaaaaaaaaaaaaaaaaaaaaaaaaaaaaaaaaa

SEQ ID NO: 204105 - DNA, 601 bp, Human
cgagagggaaggacttggtctgctacattccttttttttttttcttaagccagttcaaattgggctactttcaaaatacaaccaaaagtcctgactcatacactgacctcaaataggtcttttcatttttctgagcctcaagtttcttcatcccatgtaaaattgagatggttgtggtaatgatcaaagtggtgatgatgatgataatgaaggtgataacattcacagggttactggagtatcaaatgagataataattatggaagtgctttgtgacctgatgttagtaattgtcacttaygtttttagcattttaagactttctgttgactcagtaaatgggggaaaaaactacattagtgaacataatgttttcctattatctatagctataggtctctcttagaaattctattagtaaagagtcaaggcatgcatattgaaacagaaaatcccagtaaatctcttgggttacaaaacggagtaagaaacatgcaatgctgtcacagctaattagcaagtgttctagaacactgatgaggtgtctggcgtgtgtcatgtgctgtagaggcaactggagtacatggtctctgcctccaat

SEQ ID NO: 204106 - DNA, 601 bp, Human
caccttgccatcgagagggaaggacttggtctgctacattccttttttttttttcttaagccagttcaaattgggctactttcaaaatacaaccaaaagtcctgactcatacactgacctcaaataggtcttttcatttttctgagcctcaagtttcttcatcccatgtaaaattgagatggttgtggtaatgatcaaagtggtgatgatgatgataatgaaggtgataacattcacagggttactggagtatcaaatgagataataattatggaagtgctttgtgacctgatgttagtarttgtcacttacgtttttagcattttaagactttctgttgactcagtaaatgggggaaaaaactacattagtgaacataatgttttcctattatctatagctataggtctctcttagaaattctattagtaaagagtcaaggcatgcatattgaaacagaaaatcccagtaaatctcttgggttacaaaacggagtaagaaacatgcaatgctgtcacagctaattagcaagtgttctagaacactgatgaggtgtctggcgtgtgtcatgtgctgtagaggcaactggagtacatggtct

SEQ ID NO: 204107 - DNA, 601 bp, Human
ttaacccatctacctctttgttctaaaaacaaaaaagagctatatgaggttcctgttaaggggcacaagttaatgagagttgtggccgtaactagagctacaattagctgttgaagtctctttgctttctcatagcctgagctaatcagtgactctgtggtgaaaagagatgagaatggtttcatttttttagtaggtttttgctgataacataccccaaaagaaccattttgtagggtcaaatgtttagtattatgtgtttttttaaaaaggtagtttcaacttcaacaattacataatraacatatggaaggaggtaaaatgaggaaatgcagtaagaagagggtagggagaaggagagaaaaaggaaaacggaaaaaactcaagagtgaaaactaagtggtgtgtgaaaatgtcattgtgcctgggtggttgaagtcattaaagtcagagagccaaaaatacctaacagagtggagcgaaaaaagagccggacagaacagtgagaataatatatcactgatgtaaaaacaactcatatgatgcttgtaaatgtggaaactataactatccctggaggggtatagagatgagttcaatt

SEQ ID NO: 204108 - DNA, 601 bp, Human
tgggatttgcagaaaaatgcaagccccaggaaaaactaaaaggttatacaaaggctctttctactatcctggaatggaaaataaaataactttagggaaagatgcatgagtcttttgcaagatactgaaagatttggggcaaacctgataacatgtcaccctttaacccatctacctctttgttctaaaaacaaaaaagagctatatgaggttcctgttaaggggcacaagttaatgagagttgtggccgtaactagagctacaattagctgttgaagtctctttgctttctcatagcctsagctaatcagtgactctgtggtgaaaagagatgagaatggtttcatttttttagtaggtttttgctgataacataccccaaaagaaccattttgtagggtcaaatgtttagtattatgtgtttttttaaaaaggtagtttcaacttcaacaattacataatgaacatatggaaggaggtaaaatgaggaaatgcagtaagaagagggtagggagaaggagagaaaaaggaaaacggaaaaaactcaagagtgaaaactaagtggtgtgtgaaaatgtcattgtgcctgggtggttgaagt

SEQ ID NO: 204109 - DNA, 601 bp, Human
tggaaaaagtgccaaattatttgtcaattatttgtgcactgagtaattaaaagaattcagcaacctaccttccccctttttttccctcacgcccaacaaaacccaaagggagagaagaaaggtctacaaaattcctcttttaatatcaatgagctctactagctaaggcaaacgataggtacttggtgtccctgaagtccttcaaatccctgggtgacaactcaagattctcaacaaggtcatggggtgattttatacctatatatctccattgcctggcattaactgaacttcagatacrcgcattttgacctaatttgttatttgacctcattttaccaaaacgtgatccagtgtaatgcatgttccagaagagaaagtgatagagagtaaagacattccattcctggctggctgtgcagtagttctttcagcagcccatattctcaccaattgaaaagatgcatgctggaatgcacactggctttatgactttcagattggctttatgacttattggattcagattggctttatgacttattggctgtgaagcattaggtaagttacttaaactccctaagcctcgatttctttatct

SEQ ID NO: 204110 - DNA, 601 bp, Human
cttggctctggttcccggaaatcatcctttttaactaagctttggctctggcttataagatgagacatatgttagacttaagataggagtcaatgacaataggagagttgagaatgagcctctcactgacaaacacgtgagagcagcatgaaaccactaaatatgatggtgggctaagaattgttgggctgatctgacaaaactttggcatggaaaaagtgccaaattatttgtcaattatttgtgcactgagtaattaaaagaattcagcaacctaccttccccctttttttccctcacscccaacaaaacccaaagggagagaagaaaggtctacaaaattcctcttttaatatcaatgagctctactagctaaggcaaacgataggtacttggtgtccctgaagtccttcaaatccctgggtgacaactcaagattctcaacaaggtcatggggtgattttatacctatatatctccattgcctggcattaactgaacttcagatacacgcattttgacctaatttgttatttgacctcattttaccaaaacgtgatccagtgtaatgcatgttccagaagagaaagtgatagagagt

SEQ ID NO: 204111 - DNA, 601 bp, Human
aaatctgactctagtcaagtttgagaagggctgcgccataggttcatttaaaaaaaggactgagcttagttgtttgccaggcttcccaatggctgagagggacatggaatggtgaactgagcttcccctgtcagttttcagagaaagaatacaaaagacatagagcagagaggcctgttgctttttatcatcaaaaagaacagcaaggttctcaaccaaaagtattcttcagatatcctttaataggcttctttttaaaaaatcattcagttaaatataaatggttggaccctgtcccagwcctactgagtaaaaatctccagagattgaagcctgggcttatgctttaaatgttccacaaattatacagattgaagaccaccacaggcctctctgaggctaagctggagcccctaaggagctgcgcctattgatagttgtccccagaagggcaatacaacaggtggcttctggagagtatgttagttatggactactgactaacaaattcccccagttaaaatatggcttaaaattccaggccagccacagtgactcatgcctgtgatcccagcactttgggaggctgaagtgggaggat

SEQ ID NO: 204112 - DNA, 601 bp, Human
agcatgcaaatacgtcatttacaatgttttcttttgaaggctggcatttgttttcaaagaaacgacatcttgggaaacagccactccacaggtattacacaaacaaaagtgatgccagcaaaaatgaaagaaagaaaaaagggtattttctttgttgggttgccagcatggccctaggataaagcagacttgcaaacagaggtacaggttggtgttgcagaggcccattttctccaggttttgacagcgcttatcattattattaatttttaagtaaactttaaaagtgtaacatacagayggaaaagttcacaaattgtaggtgtccacctcaactgtatttttgcagagaatatattcgtgtcactgtcactcagatcaagaaatagaatattacagtcatcccagaaattccttttgtataccctttccagttcctgtcctctcatataatcactattcaaatttctaacactatggattacttttgcctcaggcaaaaatggatgaatttttgtttgctttcattttttgttgttacctgaagtgtagggaggatctaggacaatttctgaggcaaagttgaaataccaggtcccat

SEQ ID NO: 204113 - DNA, 601 bp, Human
cttttcaagttattctgccaatattcattattctaggaatttaaaacatacaaatacttcatttacaatattttcttttgaaggcctttttaaaaattttgacaaaggtaactttattaaagcaaagaactgaagataattttaaagaactctacctccaccatctttcctaacttctatattcattgagaaattgtgcaagattaagtttacttttttccagcactgctgttttggcttgtcttgctagtttcatcttcatttctgattctggttctagaacttcatggtcactttcagrgtcagcctcagcaatgtgatgtctcctcttcatcatagttgaagctatcacttttctctgtcccctgttagtcttttgttgagtagattttgatgccagggttgcttttacatccctaagaagagtcatatgtacttccttattcttttcatcttcattttgaaaaatagttgtagtcaagctggcatcctttgctgcttcaggctggtcaccaaattctttatttcctttttgctaaccgaatcttgattttctccaaagctttcagatatgccctctcctttacttgctccagaatcc

SEQ ID NO: 204114 - DNA, 601 bp, Human
tcttctatttcttgaaaactttatttttaattgacaatgatggttattaactggcttttcaagttattctgccaatattcattattctaggaatttaaaacatacaaatacttcatttacaatattttcttttgaaggcctttttaaaaattttgacaaaggtaactttattaaagcaaagaactgaagataattttaaagaactctacctccaccatctttcctaacttctatattcattgagaaattgtgcaagattaagtttacttttttccagcactgctgttttggcttgtcttgstagtttcatcttcatttctgattctggttctagaacttcatggtcactttcagagtcagcctcagcaatgtgatgtctcctcttcatcatagttgaagctatcacttttctctgtcccctgttagtcttttgttgagtagattttgatgccagggttgcttttacatccctaagaagagtcatatgtacttccttattcttttcatcttcattttgaaaaatagttgtagtcaagctggcatcctttgctgcttcaggctggtcaccaaattctttatttcctttttgctaaccgaatct

SEQ ID NO: 204115 - DNA, 601 bp, Human
ccctaagttctcactcttcagtaaagctgcagagcagaatacaaactagcattctcaagagcattaatgagagctcaacgtgtttttcttctatttcttgaaaactttatttttaattgacaatgatggttattaactggcttttcaagttattctgccaatattcattattctaggaatttaaaacatacaaatacttcatttacaatattttcttttgaaggcctttttaaaaattttgacaaaggtaactttattaaagcaaagaactgaagataattttaaagaactctacctccaycatctttcctaacttctatattcattgagaaattgtgcaagattaagtttacttttttccagcactgctgttttggcttgtcttgctagtttcatcttcatttctgattctggttctagaacttcatggtcactttcagagtcagcctcagcaatgtgatgtctcctcttcatcatagttgaagctatcacttttctctgtcccctgttagtcttttgttgagtagattttgatgccagggttgcttttacatccctaagaagagtcatatgtacttccttattcttttcatcttcattt

SEQ ID NO: 204116 - DNA, 601 bp, Human
tcttatggggggcactcactgtctcctgcagtgatgtgaagtgtagtactactcatcatcaacaactatgcccagtaatgtcccacctagatcctgagtttcaaaataacaattttgcagatggcctgagagttagaagacccaatgcaacttggccttgttaacatttgaaaccaaacttttacagtgactaaaccgtcttaccacaagcattaagttgtagaagagagatgatttggaaagtgagatgtcactaggggaactttagccataattagtattcatttttttttttttttttgagacggagtctcgctctgtcgcccaggctggagtgcagtggtgcgaccttggctcactgcaagctccgcctcccaggttcacgccattctcctgcctcagcctcccgagtagctgggaccacaggcacccgccaccgcacccagctaatttttttggtatttttagtagagacggggtttctccgtgttagccagaaagtattctttttaaggaatttgcaaagccagtctccccaataagatacaaaaattttatgtgatggaacagggaattctttaggtgacaactgtcctcgcgc

SEQ ID NO: 204117 - DNA, 601 bp, Human
aggaattttatctgtagcacatttagcttccacttaatcctcaaacctgtggtgtaaaggcatgaattggcctaggaaggggtaacaatggggagagagatgcactaaatgtattctatttaaagtccaggcccaccacgctggctcatgactgtaatcccagcactttggaaggctgaggtgggcagatcacctgaggtcaggagttcaagaccagcctagccaacatggtgaaaccccgtctctacaaaaatacaaaaattagccgggcatgatggcgggtgcctgtaaccccagctayttggaaggctgagactggagaattgcttgaacccgggaggcagaagttgcagtgagccgagatcaagccattgcactccagcctgggtgacagagtaagactcggtctcaaataaaataaaataaaataaattaaaataaaaataaaagtccaacaccaaaacttaggccagaactgtaattggattactggagaaacagagagagagagatctgtatactgtaattgtggtaaaagaaggaaattctcaacagatactttatgtcgttaacttcttattttgaagtagttgtagattag

SEQ ID NO: 204118 - DNA, 601 bp, Human
tgcatcttttaggaattttatctgtagcacatttagcttccacttaatcctcaaacctgtggtgtaaaggcatgaattggcctaggaaggggtaacaatggggagagagatgcactaaatgtattctatttaaagtccaggcccaccacgctggctcatgactgtaatcccagcactttggaaggctgaggtgggcagatcacctgaggtcaggagttcaagaccagcctagccaacatggtgaaaccccgtctctacaaaaatacaaaaattagccgggcatgatggcgggtgcctgtarccccagctatttggaaggctgagactggagaattgcttgaacccgggaggcagaagttgcagtgagccgagatcaagccattgcactccagcctgggtgacagagtaagactcggtctcaaataaaataaaataaaataaattaaaataaaaataaaagtccaacaccaaaacttaggccagaactgtaattggattactggagaaacagagagagagagatctgtatactgtaattgtggtaaaagaaggaaattctcaacagatactttatgtcgttaacttcttattttgaagtagt

SEQ ID NO: 204119 - DNA, 601 bp, Human
ctgatactaatttgctttacttcttaattcacagaggattttaataatatactcacacatccttgctgctgctggcaggaaacagattgaaatatatctagccacatgcttaatcctgctgctcagtgttaatcaattaagccacatgcttaatcctgctgctcagtgttaatcaattgagaatattttagaatcgaagatgaccaaactttgcatcttttaggaattttatctgtagcacatttagcttccacttaatcctcaaacctgtggtgtaaaggcatgaattggcctaggaagrggtaacaatggggagagagatgcactaaatgtattctatttaaagtccaggcccaccacgctggctcatgactgtaatcccagcactttggaaggctgaggtgggcagatcacctgaggtcaggagttcaagaccagcctagccaacatggtgaaaccccgtctctacaaaaatacaaaaattagccgggcatgatggcgggtgcctgtaaccccagctatttggaaggctgagactggagaattgcttgaacccgggaggcagaagttgcagtgagccgagatcaagccattgcactcc

SEQ ID NO: 204120 - DNA, 601 bp, Human
cataagcctggaaccgtcaggccaactagagaggaagcctggtaataaactaatgaaaggacagggaaagaaagagatggagacttagacctaatacattatttaagtccctggatcccaccatgcctgaagcttatctttggacattgcagttatcagaacccgggcatgctcattttgctcaagctaaattgagttgagttttctgccacttgtaattgaaagatccttgagtatcaggccttttcctaataaaaacacatgcatttggagagagtagaaagtggggagtgatagagaygtgactttcaaaattatatcagccatccagatttatgctcttgttttcttcaggaaccctaacacataaactcatgagggctacgggtggtttgtgtttattatgaatttggatgctcctaccaccagcattgtccctttcgttctttgaaatctttgagagataggacaataccaagcccaacaacccatttggtgttaaatttttaggctaagacccgcgcatgatctgctgcaaacaaagaacaatggtggaaaacctgagtattatttcgggtgccatttgactgggccttctcag

SEQ ID NO: 204121 - DNA, 601 bp, Human
atgagaatgtctaataatatgtctgctaataatttgggataagcaaaaggcatgagacaaattataggtgagaaagagtaacttttggaagattttttaatttcatgaatagtggtaatgattttaaacatagcttgtgattgaagagatgagagaaaagtaccttcaagaattaagaccatcaacttggtagatgcagggttgcatgtgttggccagcctccctttgccccttcagatccagtctctacctttcccatccttctctgtaccctggaagactcactttaagagtgcatccrtggggcttcttacctctggcttccagccagcttcagcccgtggaagacactagcagggggtcagtgggcaggggttggcaggggctgcatttctcttccaaagaccacagctggtagtgggtggcacttttctacagctacaagcctccctagtctcaggtaactgctgcttctccttgccctttctggtcaagggatggtagtggcttcttactactgttggccctggagttcttctctatctcttattggtttcccaaaccttggctataccttataaattattcctgcattaaatcc

SEQ ID NO: 204122 - DNA, 601 bp, Human
tgatatttgtgatactataagaaaggcatcgtattaaggatttgccattcattataacattttgctaaaaaccattcatatatctgcacaccaggattcagtattaaatattcattcaaaaaaatctagtttggatttgttcccttaaacttgatctatggtaatcttctgagaagtgtgaaaatgaaggcaataaaagacattcttgcttctcataattatccatgatcattattgctcttacagattctctgcataataccctgaaggagaactctggaacgatgatctgaaattacaycataagaacaatcatatgctaaaaacaggaagagctttataggcacatttattgctgttccatgagaatgtctaataatatgtctgctaataatttgggataagcaaaaggcatgagacaaattataggtgagaaagagtaacttttggaagattttttaatttcatgaatagtggtaatgattttaaacatagcttgtgattgaagagatgagagaaaagtaccttcaagaattaagaccatcaacttggtagatgcagggttgcatgtgttggccagcctccctttgccccttcagat

SEQ ID NO: 204123 - DNA, 601 bp, Human
ccgcttttaaaaatttgaaattaaattaaatataatctgtacaaccttgtcacagagtgactgtgacaaatttacaaaatcaaaatataacaatataggaaaagacaaagaacatcaatttaagatcaattacagctagatatatacagggtcacattttatgtctttacaaataccaagcaaattcatgatatttgtgatactataagaaaggcatcgtattaaggatttgccattcattataacattttgctaaaaaccattcatatatctgcacaccaggattcagtattaaatattyattcaaaaaaatctagtttggatttgttcccttaaacttgatctatggtaatcttctgagaagtgtgaaaatgaaggcaataaaagacattcttgcttctcataattatccatgatcattattgctcttacagattctctgcataataccctgaaggagaactctggaacgatgatctgaaattacatcataagaacaatcatatgctaaaaacaggaagagctttataggcacatttattgctgttccatgagaatgtctaataatatgtctgctaataatttgggataagcaaaaggc

SEQ ID NO: 204124 - DNA, 601 bp, Human
tttttaaggcagatggtggggctgatatatttagaggctccaaaaatatcattctgttaattacactgtcaagatcttgattatagcagcctgttttactagggccagggctattttacattcacactgagattcttctaatgtaggtgggcaatgtagctagagaatgaaatcacttggttggttctagttacctagaattgggggggatgagtaaattgctattgttggaactgaaaattaatggtgatctaacaaattatgtaagaatatagactatagtatgtatatatatatatakagagagagatcaatatagtcacatagataaataggtaattagatagggatgaatagatagatacagggaggtagacagattgagaaatctctcagttctgcctttgcacagtagtgctgggtaataaaaatgactgtgaaagctgaaaccacactaagcaatcttaatcagttggaaaaattaggatcattacatgacctttaaaattttttatcaaaatgttaaaaactgccttactgtcaattatatatgcatagggagatgaaaaatagagtaaatgtttatttagtaatctctaat

SEQ ID NO: 204125 - DNA, 601 bp, Human
atttttttcttagtcttgctccatctcagaggtgattcactcaggaacttgatgactctcttttaaagcaacacaataggactattagcacttaattgcattaacagcctgtgttttctaccataaccaatagtcttgatttagggatgatgcaagccagggtagcttggacagtagttctatttctatctcttatcagatgggagttccctcaggtcagagactattttctccctggaagaagcagtgagaaattctgacttaggtaatttttttaaggcagatggtggggctgatatawttagaggctccaaaaatatcattctgttaattacactgtcaagatcttgattatagcagcctgttttactagggccagggctattttacattcacactgagattcttctaatgtaggtgggcaatgtagctagagaatgaaatcacttggttggttctagttacctagaattgggggggatgagtaaattgctattgttggaactgaaaattaatggtgatctaacaaattatgtaagaatatagactatagtatgtatatatatatatagagagagagatcaatatagtcacatagata

SEQ ID NO: 204126 - DNA, 601 bp, Human
agtatatgtgactaataaactgctgctaatctcatctgtccagtgctgagtagagtgcgttcaccatctcatcctgtttcaggtagggaatatctcccttaccagtggggcaaagaggaggtgaccagaaaaatcaaataatagaaattaataggaaaatcattgtgttttgaccaaagtcaggcagctcttctggaacacatctatttcataaagaaagggcaatccacaatgcccaataagattaaagtaggttcaacagagtctgctagccacgtgcattagtctgttttgtgttgcygcaacagagtaccgtagactgggtaattttttgtttgtttgtttgtttttttgagacagagtcttgctctgtcacccaggctggagtgcagtggtgcaatcttggctcactgcaacctctgcctccggggttgaagtgatgctcctgcctcagcctcttgattagctgggactacaggcatgtgccaacacacctggctaatttttgtatttttagtagacatggggtttcaccatgttggccaggctggtctcaaactcctgacctccagtgatccacccatctcagcctcccaaaatg

SEQ ID NO: 204127 - DNA, 601 bp, Human
cctctccagctccgtaaagatctctgttttcaccttgatgcagcccatatgtagatatggatgttcttaaatcagattctagaattacagcttcacctatatttctaaccctaattataaataaaatcaatattttaaaaacttcacactgactgacttgctaaaccagaaaatgaattcagcttacaaacctgaaaataccaacttgagagagtttcaggatggaaaatgaaatgtgttcatttgcattgcatagcagcccagtactattagaagtaataaaaagcccaaaccaaacatrtaaggatgcaaagaaactctgaaaatgatgtttgagaatttcaaagcattaaaaaaaataattattccatgatgtgagggacaagggagcaagtaaatgccaatgtgagttatcagaatgtgaatacagctgtaaataaaagtaaacttctaggtggtggctataaccttcaacatgtcacagtactagccattatatttaagtctgtcccacctaaaggtcccatatacctaaaggaatccctgctggaattcctcccctcatgggaacacaccagtgattatagtagatattgttggt

SEQ ID NO: 204128 - DNA, 601 bp, Human
cactgacactattgacttcaggttatcttatggtgtgttcagagatccaggcacacaaaagtgaatgtctgcctgaaactttgtaaaatacacaaacatgcctactgatggaatcctctagcacacttttttccaatgcctcttatgagaatccaactgggttaaaatgcatctttcctcctccctccctccctcccttccctccctccttccctctcttcctccctccttctctctcttcttccctctcttttcttttctttcttttttctttctttctctccctctccctctctctctmcctcccccaggctggagtacagtggtgcagtctctgctcactgcaacctccacctcccgggttcaagtgattctcctgcctcagcctcccaagtagctgggattacaggcacccgacaccatgcccggctaatttttgtattttcagtagagacgaggtttcacagtgttggccagggtggtcttgaactcctgacctcaggtgatccacccaccttggcctcccaaagttctgggattataggcgtgagccaccatgcccggcctttattccctctttcatgcccactggtggaggtgc

SEQ ID NO: 204129 - DNA, 601 bp, Human
ataaaatccatatctatgggttagtttctactaaagccatcaagaaccctaaaattcctaaaaatacttcttccttcaatttctggtatcttgcagtgaaaagaaatacagcaattatgaatacattattttatgcttttattgaaagatcatttttatactaatttaaaattgccttttaaaatcaattttatataaactttagaaaggtgttcttataatttacagttcattaaatatggagttacttctacaagattcataatggggtattggtgaaaattatacatatatatatatagagagagagagagagagagaaagagacagagagagagaaagagagagatttcattttcagggaacttggaattgatttacgttaactctgacttatgacctcttttccagacatgaagtaatatgttctttatttcaggaccttgtgaaattagacagcaggtcatctatgatccatttgaagcttttaaatctttccccttttgaagactattcagcctgatttttcccatcaagctctctttggaaaccccatttcacacagtgcattctgcctccctaattttgtcagcactattgt

SEQ ID NO: 204130 - DNA, 601 bp, Human
gaaataaattatagcatgcacaggtctgtatttgaaattcttaggttccatgtttgtcttcctcatttgtttgtgagttccctgagaatatctttgtatctccagcttactgcctcacctattataaacaattatctaaaattaatttccttgtcccttacattcatattgcccattctctttatcagcacatatcacaatctgaattgtttgttttcttacaaattatctacctcccctgctgaaagtaagctccagtgcagcaaggaacttgtctgacgtgtcaccatcatagtcccastactttcacttgcttggcatattgtatgtgctcaatagttacttacagaatgaatgaattataggtgctgaatagtgtttatcaaatggataagaaaatgactagtcatatatttgtttgtttaaaaaatcacttgattatttataagcaaaaagatgttcaatccctaaaagatgagggataaataaaaaatagatttctgtgacagttccattctggtttctggctgttggacgctggatgaaattacctttcaacccagttattattcaagttaaagccttgaagcttggcaaggag

SEQ ID NO: 204131 - DNA, 601 bp, Human
gtatcatacataaagctctaggctatatttcacaaaagcaatttgctacatctgtctaattttttaaaagaaagataatccacagatttataaatactgggtgaagactgaattgatatgtaaaactcactagaacgagtgctaaggtagaatagaacacctacctgacccagtggtggggactcaaaaaatgctgttgaattattttccaaaggaacttacggtattgggcttcctcgtgcattttggatgaggtgttttgttggtcagccttggtgggcataatagcgtgtccaacctygctccatactcagaactcgcctccagatccctagctctgagaccggaggtctccttagaataggtacaaggtgatcagttaagccaaacagggtgaaagtgaagaagagagagaaaatacatttggactaagggggatgcccatgtgactgtaaaagtagattttcatatactgcctttgaaggcgattccaaagaagaattctaaaaatgcaatacagcagcaaacgagtgaaggtacaactgcctaagggtgttgctaagaaaggcagtatcacctgaatatatgtatatatatatat

SEQ ID NO: 204132 - DNA, 601 bp, Human
gatcagctttcttattagcacaattcaaagagtagtttttattctcaatgatcacatcttttctggcagaatcccaataagcactttgcaccatgacaacgaggaggtgcacacaacattgctgaagatgcctgtgctcctcctgaaagggaacgtggctcctgcagagcgaggccagcagcctggtgcacaggcatatgctcactcatcaaatcatctgctctggcagataatggtgtagaacaagcttgtccaacccatggcccatgggccacatgtggcccgggacagctttgaatgwggcccaacacaaatttgtgttgaaaacattatgagtttttttgcaattttaaaaagctcattagctatcgttagtgttagtgtattttgtgtgtgggccaagacaattcttcttctaatgtggcccaggaaagccaaaagattggacacccctggtgtagaatcagtgagctcttaccatgttaaaggcagtaaggaatataaaatcactctataaagccccaagcaaatatttaattttgctattataactcatgtggttcttagagttgggacaccaaggaagaatatttttgtggaa

SEQ ID NO: 204133 - DNA, 601 bp, Human
taattcatcattcagcacccacatagtgcctacacacctcttatcaccttttcctggaggacaacaaactcttgtaggagtgaaaaaataatattaggaaaggaagccttcctcacatctccaagtcggtaatgattcaagaataattatttaatagtacattttgggtagtatcatcaactttccttttctttaagggtggaccaatgaggaagagattactagcagttggtgattttagattcgactacttgactcaacactggtgcttaagattagcttgatttttttttttttttttgagacagtgtctcactctttcacatggcctggggtacagtggtgtgatcatagctcactgcagccttgaattcctgggcttaagtgatcttcctgcctcagccttcccagtaagctagaactacaggggcacaccacaacacctgactaactaaaaaaagttttttttttttttttgtaaaaatggggggctcttgatacattgccccaggctggtctcaaactcctggcctcaagtgaccctctcaacttggcttcccaaagtgctgggattgcaggcataagccaccatgccaggcct

SEQ ID NO: 204134 - DNA, 601 bp, Human
cagcacacactgagcacatcttgctcaaagtagccattggggaagatgatgaatatgcggcctcattaaaaactgaggggaggaaaaatccctttgcagaacccacagggcttcatggttgtcaatttgcctttctgcttacatgaagaatttattggatttaccaccaaaataggagaaactgaacttgcaaatggcattatcatatttccaggaaccaaataccattcattagatggccaagtgagcagcctcaaggtcagagctgaaagttttaaagcaagtctctttaagtgcaaaygttatttctgccatctgaataacataagccagtttgaatcgaacggaggtaaaaagattacagcatgtctttctccttccttagttttcttcctttcctttcatttcctttccttccttttatcttttcgtctttctttcctacccatttctctcttaactggatgtagctctttaaaaactaactgttcttctccctttatcttttcttctttctttcctaccaattttttccttaactggatgtaactctttaaaagctaactattcacctcagggtggggcctcctaaattatcctc

SEQ ID NO: 204135 - DNA, 601 bp, Human
agtatcagagccaagaatcaacatgacggatccaacaatatgtctgatcttaggtcagattctcagctgagggctcaccgaatgcaaaggtcagcagcttgacatcagctcaacagcacacactgagcacatcttgctcaaagtagccattggggaagatgatgaatatgcggcctcattaaaaactgaggggaggaaaaatccctttgcagaacccacagggcttcatggttgtcaatttgcctttctgcttacatgaagaatttattggatttaccaccaaaataggagaaactgaacktgcaaatggcattatcatatttccaggaaccaaataccattcattagatggccaagtgagcagcctcaaggtcagagctgaaagttttaaagcaagtctctttaagtgcaaatgttatttctgccatctgaataacataagccagtttgaatcgaacggaggtaaaaagattacagcatgtctttctccttccttagttttcttcctttcctttcatttcctttccttccttttatcttttcgtctttctttcctacccatttctctcttaactggatgtagctctttaaaaactaactg

SEQ ID NO: 204136 - DNA, 601 bp, Human
aaaacaaaaagatgctagtgcactgggcatcttgcttccctccccacaactccaactcactgtgcatctggcattagcgtcgccagagccggggttaatatgtacaccatgaactcattagctgcccattagtatcagagccaagaatcaacatgacggatccaacaatatgtctgatcttaggtcagattctcagctgagggctcaccgaatgcaaaggtcagcagcttgacatcagctcaacagcacacactgagcacatcttgctcaaagtagccattggggaagatgatgaatatgsggcctcattaaaaactgaggggaggaaaaatccctttgcagaacccacagggcttcatggttgtcaatttgcctttctgcttacatgaagaatttattggatttaccaccaaaataggagaaactgaacttgcaaatggcattatcatatttccaggaaccaaataccattcattagatggccaagtgagcagcctcaaggtcagagctgaaagttttaaagcaagtctctttaagtgcaaatgttatttctgccatctgaataacataagccagtttgaatcgaacggaggtaaaaaga

SEQ ID NO: 204137 - DNA, 601 bp, Human
gagattgcgccattgcactccagtgtggtgacagagcgagactacatctcaaaacaaaacaaaaaaaacaaaacaaaaagatgctagtgcactgggcatcttgcttccctccccacaactccaactcactgtgcatctggcattagcgtcgccagagccggggttaatatgtacaccatgaactcattagctgcccattagtatcagagccaagaatcaacatgacggatccaacaatatgtctgatcttaggtcagattctcagctgagggctcaccgaatgcaaaggtcagcagcttgrcatcagctcaacagcacacactgagcacatcttgctcaaagtagccattggggaagatgatgaatatgcggcctcattaaaaactgaggggaggaaaaatccctttgcagaacccacagggcttcatggttgtcaatttgcctttctgcttacatgaagaatttattggatttaccaccaaaataggagaaactgaacttgcaaatggcattatcatatttccaggaaccaaataccattcattagatggccaagtgagcagcctcaaggtcagagctgaaagttttaaagcaagtctct

SEQ ID NO: 204138 - DNA, 601 bp, Human
ttatctttatatggggatctaaagtttatgcagtgctttcacgtgcattatttaccatttatgaggcaggatgcaggagctcagagagactgtcagtggtttgcccaagaaaaaacagaaagagcagtgaggatgagaattggttctttagggctccatgcacactgtttatccacagcattacagcaggcatccttctttctcatataacatacattcttagggaaatcagtgcaatacagtgcaaagttatttatcctttctgtgtctcggttttctcatctgtaatatgaggcagctraaacaaatttaagagagataccctgtccaaagtaaaacagctatccttagtagcctggtggagtgtataatcaattttcatgactccttaaccagttcaaccaatctgtcttaaactagtggccagaaacacagtggtaggcacttcaggtgcaggaacaaattagacacaactccttctctggcatattatgtctttcagagtgtgctggtagaaattctttacaccactgccttttgaaaacttgtttccaaggccagagtagcatgcccttctatgccttagctctggcctgccagc

SEQ ID NO: 204139 - DNA, 601 bp, Human
attacagtactgctagtatacagtaatgtcatgtactacaataatgtaccagatgctcagtgacagtgaatgaataaatataaggtttactgacatttatacaggaaaaagtacatggcattctttgtttctgtctttttaaggataaaatgtagaattaccatgtatccggtagtggttattaatctttgttgggtatcagagtggtgagattgatttaggattcactatattaaacaaattcaaatgtatttgtttgtatcaggacatctcacttttcagttatttgactgtggactcytcgttttctttttctcatataaactgtagtgacagagttggggaagcagtgtcttggaaaataataataagagcttatctttatatggggatctaaagtttatgcagtgctttcacgtgcattatttaccatttatgaggcaggatgcaggagctcagagagactgtcagtggtttgcccaagaaaaaacagaaagagcagtgaggatgagaattggttctttagggctccatgcacactgtttatccacagcattacagcaggcatccttctttctcatataacatacattcttaggga

SEQ ID NO: 204140 - DNA, 601 bp, Human
ggagatcaacattacagtactgctagtatacagtaatgtcatgtactacaataatgtaccagatgctcagtgacagtgaatgaataaatataaggtttactgacatttatacaggaaaaagtacatggcattctttgtttctgtctttttaaggataaaatgtagaattaccatgtatccggtagtggttattaatctttgttgggtatcagagtggtgagattgatttaggattcactatattaaacaaattcaaatgtatttgtttgtatcaggacatctcacttttcagttatttgaytgtggactcctcgttttctttttctcatataaactgtagtgacagagttggggaagcagtgtcttggaaaataataataagagcttatctttatatggggatctaaagtttatgcagtgctttcacgtgcattatttaccatttatgaggcaggatgcaggagctcagagagactgtcagtggtttgcccaagaaaaaacagaaagagcagtgaggatgagaattggttctttagggctccatgcacactgtttatccacagcattacagcaggcatccttctttctcatataacataca

SEQ ID NO: 204141 - DNA, 601 bp, Human
gcttagaaacattaaagtagcttgcccaggtcacaaggctagtaagtcatagaaccaaggggactaactccatagcatgtggtcttccacaatgcagtatacagtggtggttattaaacactgttaggcatcggaatctcctgggagcttgctgaaaatatagatttccaagccctagccactggggtgattctgaattagtgggtttaaggtagagtccccaaatctgcttttattttatttttttgagatggagttttgatcttgtcacccaagctggagtgcaatggctcgatctcarctcactgcaacctccgcctcctgggttcaagcgattttcctgcctcagcctccctagtagctgggattacaggtgcacacccacccatgctggctaattttgtatttttagtagagacaaaagtacagctggccataatttttttgttgatacagaataattatacatatttgtggcacacgtggtattttgataacatgcatgaaatgtgcaaagatcaaattagggtatttaggataaccatcacctcaaacatgtatcatatctttgtgttgggaacattccaaatcttctcttcta

SEQ ID NO: 204142 - DNA, 601 bp, Human
actgaacagtgagccttcgagaaagccatcgtgtttaactgatatttccactttgcgtagtggtccttataataacaataacagtagccattactacgaatgagatcttataatatcagatgttataacaagcactttgcatatattatatcatttaatcttcacaaaatatttgcaaagtagttattacatccctttcacagataagaaaactggagcttagaaacattaaagtagcttgcccaggtcacaaggctagtaagtcatagaaccaaggggactaactccatagcatgtggtsttccacaatgcagtatacagtggtggttattaaacactgttaggcatcggaatctcctgggagcttgctgaaaatatagatttccaagccctagccactggggtgattctgaattagtgggtttaaggtagagtccccaaatctgcttttattttatttttttgagatggagttttgatcttgtcacccaagctggagtgcaatggctcgatctcagctcactgcaacctccgcctcctgggttcaagcgattttcctgcctcagcctccctagtagctgggattacaggtgcacaccca

SEQ ID NO: 204143 - DNA, 601 bp, Human
tatcaagaaggcagtgccaggccaggtgcggtagctcacgcctgtaatcccagcactttgggaggcgaggtgggcagatcacaaggtcaggagatcgagaccatcctggctaacacggtgaaaccccattactactaaaaatagaaaaaattagccgggcgtggtggcgggtgcctgtagtcccagctactcgggaggctgaggcaggagaatcgcttgaacccaggaggcagaggttgcagtgagccaagatcatgccactgcactccagcctgggtgacagagcgagactctgtctcgaaaaaaaaaaaaaaaaaaaaaaggcagtgccagacgtgtggcaaatttcctttgggtttcctggaagtactctcagtattacttatttttctgtgtataggtgaggttggttcttacctagaagacacctacttcaagatcggctcacatgtcttctctggtgagccttccacaagtccctccaaacagagtgagtcactgaatttccatttgatttcattcacgtctcccctgtagtgtacatcatggtgcctgcaattagctgctaaaatttaacactggcactgaacagtgagccttc

SEQ ID NO: 204144 - DNA, 601 bp, Human
tggttctgtgggtcttgacctcttgctggccaaataagagccctgagcaggtctgaccctagagcaagcacctaatctaaatgtgctgaattttcttgataacgctaaacagagtgcatatgaaattgatgctggttgttaggcttatccacccttaagctttggattccttagatctctgttcagggtcacttttggccagctggtggccagttaaaccttcccccaagagtgcagaagagggagaaaagggagaagaagcaaaatcaaaagttggcaaatagcaattagaagctctggaaaaaaaaatcgttaataaggaaactgggactgttattttaaattatttaaaaatatttgtggagttatattgtccacattccttacagcagtctgtgaagaaaattaagttggagaaagaataattacctctgagacgagagataatgggaagtcatgccacacagctatcaagaaggcagtgccaggccaggtgcggtagctcacgcctgtaatcccagcactttgggaggcgaggtgggcagatcacaaggtcaggagatcgagaccatcctggctaacacggtgaaaccccattact

SEQ ID NO: 204145 - DNA, 601 bp, Human
aaggatagagacgacactagaaatctgtttaaaatactagaaaaatacaggagaacacattttggaagaaagaaaaggactcttctgaaaaagaaaattactaaaaggagtactttatgaagaaggaaactgaattcccaaggaagtagtgggacatagaaagcaaaggtgagcaaagaaaccaacttgtgtgtgaacctaagtgagtattaaatggatttttaaaaaagtaattgctaccttggggagtgtaaaataagatgataaataagacactgaacaaaataacatgttaagatargagtgcagtaaaatcctgctgagatccttaaatttagggggaatgaattagagatattagttctgtttagattttaggtcacatatgtgtctaaacaagtaaaggatgactactaaaagagcagatatagactgcatagtaagtcttattccaaaatccatagaaaggaaaataaaacaaaggaaaagaacaaaggaaaagtaataaatctagttccaggcaagaaaaaatatcttaaaaactagacaagccaaagattctgaggtagaaagagttcagtgtggaattgcccccttaccc

SEQ ID NO: 204146 - DNA, 601 bp, Human
atcccaatgaacttgccatttaacttttctttttttttcttttcttttttgtgtctggctttttttaaaaaagtatactttaagttttagggtacatgtgcacaacgtgcaggttagttacatatgtatacatgtgccatgttggtgtgctgcacccattaactcgtcatttaacattaggtatatcttctaatgttaaatggccatttaacttttcattccagcaatgaaagacttgttatcttgaaaacccttgtactacagatacctaaaaatgaaggataacatctaacttacatcrttttaaatgagtagctgaaagccactgatgcaagaaaaagaaaaaagggagtgatgcagtgttgatgctatggcccagctggggtagaaagtcttggggaaaatgaagatctccataatcccagataggtttcagcatgacttgtgaatagctgagtgctacagaactccacaggtggttcctgcaaggtgaaatgttgtaactgatgtccacacttaagtctggacccttgaaagaatgcacagttcgtgaaaggatgaaaagaaatggctttattgccaacagctgtcatttggatag

SEQ ID NO: 204147 - DNA, 601 bp, Human
ctacaccaatgtgcctttgtgtacgaggaatgccgagtggatgatgtataagcttccttccactttaataatttgattcagtggtgctgactctgcagtcccctttctatagggcttggaggaacagcaagaaatgggcttagtcctttgcagtgcatcaatgcacaggacatttatctgctttccagagtcattgtgctactcccataattcacagcttgtctctgaaaggaggttttacttactccatttcctatggagacatcaagctctccagaagtagctacaaggctaacagctrggaatctgtagtttccagtgatattaccacgtctaactgtgctttttaagaaagtttatttgagacaagagtagtgtatgttcacaagcccagccatgacacgtatctttggttagtgtttcttaagaagccatgctaagttatgtgttcacctctttttgtatctactgtgtattagtgactcctgcttggtaggtgtccagtagatgtttgctgttgatggtgatgaagatgacatatgtctcaaaactgagatttatataatgggaaccttctgaaatgatgacctcacatttgtta

SEQ ID NO: 204148 - DNA, 601 bp, Human
gccaacttttgcattttaaattcatacagacaactattccaaaaatagaagcatcagacctaaagactgaactatatagctcagtaaccattcctggtaaaaagatataaaccagaattcaaagccaggcaattgtttccagtaagatgtgctgcttcttcaagccattgatgtttcagagactattaatacttatagtatttataagtcattgctggatgaatgaaaatacttgaaaaatctcagaagtagtagcatcctgaatccccaagtagaggtccatgtcatattttaatctccrctctcccattaccaagagtgtggtcctgaattggtcactgcatattcctacaccaatgtgcctttgtgtacgaggaatgccgagtggatgatgtataagcttccttccactttaataatttgattcagtggtgctgactctgcagtcccctttctatagggcttggaggaacagcaagaaatgggcttagtcctttgcagtgcatcaatgcacaggacatttatctgctttccagagtcattgtgctactcccataattcacagcttgtctctgaaaggaggttttacttactccatttc

SEQ ID NO: 204149 - DNA, 601 bp, Human
acaagccaggcaggaagaaaggtgctacctctatataaggcggccaggaaaggtgaatgtcatcagggaactttaagtcaagatttaaagagtgagaacaagccttggtccttgattattcatcagtggccgtaacaaaatagaaatacacattaaaagttaataaaaataccgcacaaataatttgtattaacagtgagctgtataattgtgtgatttctatctcatcagaacctaatgattacctccagaaaatgtgaggttgacaaaatgaccttgtgtgcacatgcagatttttttwaaatatttctgaagctaattgctgcttgatgcttttgctataaatccaggttttatatttattcatgcctcatttcaaaataaatctgaagaattaaatatcgttttgacaatgataaatgcttaaataaagatatacacgatcagtcagttcaccaaatattcagactggccatttcactgttggaaaatcccacttccattcatttgctggagattgttggagattagccaattgaaccctgaaatctataatttgaagaataattaagagttattttatatatgtcaaagagatgtc

SEQ ID NO: 204150 - DNA, 601 bp, Human
cggtggacttgtcagagctgtttgaaccagagcaactccatcttgaataggagctgggtaaaatgaggctgagtcctactgggctgcattcccagatggttaaggcattctaattcacaggatgagacaggaggtctgcacaagatacaggtcataaagaccttgtggataaaacagcttgcagtaaagaagctggccaaaacccaccaaaaccaaggtggcaacaagagtgacctctggtcattcctcactactacactcccaccagcgccatgacagtttacaaatgccatggcaacawcaggaagttaccctatatggtctaaaagggggaggcatgaataatccaccccttgtttagcatatcatcaagaaataaccataaaaatgggcaaccaggagccctaggggctgctctgtctgtgaagtggtcatttttttttattcctctaatttctttttttttttagacagtgtttcactcttgttgcccaggctggagtgcaatggctcaatctcagctcactgcaacctctgcctcatgggttcaagcaattctcctgcctcagcctcccgagtagctgggattccaggcatgcac

SEQ ID NO: 204151 - DNA, 601 bp, Human
tcaagcgatcctcccacctcagccttccaaagtactgggattacaggtgaaagccatggcaaccggctgctcatgtcttaatgtataaatctcaaatgatttcaagtgaattatttcaaactttgagtttcctcgtgtgttgttttagcacctcagagggatatgtctgccctttctatagctcatgtgcaaaagtaaaggcaaaagaagacaagggtaatgggaatactgtttgataggtatggagtttcagtttgggaagatgaaaaagtgctgtggctggatggtggtgatggttgcmcaacaatgcaaatgtacttaattgaaccatacaataaaaaaaatagttaaaatggtcaattttatgttatgtatattttaccacgcattcacaaaaaaaagtgaaggcaagagtcaagcagaaggcccagaggctaaaataaacctcctcagatgttaactctccttggtcctccttgaggcttgactgcacaggttcctgggctacatcgctgtgctttgtctctgcggtggacttgtcagagctgtttgaaccagagcaactccatcttgaataggagctgggtaaaatgaggctgag

SEQ ID NO: 204152 - DNA, 601 bp, Human
ttgaactcctgacctcaggtgatccacctgcctcggcctcccaaagtgctgggattacaggtgtgagccaccgcactcaaccactaatacttattgtttgtagagacagggtcttgctatgttgcttaggctggtctggaattcctggcctcaagcgatcctcccacctcagccttccaaagtactgggattacaggtgaaagccatggcaaccggctgctcatgtcttaatgtataaatctcaaatgatttcaagtgaattatttcaaactttgagtttcctcgtgtgttgttttagcamctcagagggatatgtctgccctttctatagctcatgtgcaaaagtaaaggcaaaagaagacaagggtaatgggaatactgtttgataggtatggagtttcagtttgggaagatgaaaaagtgctgtggctggatggtggtgatggttgcacaacaatgcaaatgtacttaattgaaccatacaataaaaaaaatagttaaaatggtcaattttatgttatgtatattttaccacgcattcacaaaaaaaagtgaaggcaagagtcaagcagaaggcccagaggctaaaataaacctcctc

SEQ ID NO: 204153 - DNA, 601 bp, Human
ctaattatatacagttgatcccattcatgaagaaagctaaatcacctatgaaaataaatttcattttattaaaaagtatgaaaaaggctaaaagctttgatagaaagctactaaaaatataaattagcagtccaatttcaagctaataagcagaatttttttttttccaagagagagggcctagctctgtcacccaggctggagtgcagtgtcgtgatcacggcatgctgcagcctcaaactcttggggtcaagggatcctcctgcctcagcctcctttagctggaactacaggtgtgtgycaccacaccaggataatttttttttcttttttttcttttgtagagtgaagctgttgctacattgcccaggctggtctcgaactcctggcctccagcaatcctcctacctcagtctcccaaagtgcaggtgtgatccactgtgcctggccaagcagagaattttttaaaaaattcatttgtaccattagaacagcctattccaactaaatgagataatatgtattctttcatgctataaatatttgttaagcacatgctatgtgccagacactgtgctgggagctaggcactttgtgacaa

SEQ ID NO: 204154 - DNA, 601 bp, Human
gcaaaagggacagctcagttaaagatgatgatgatgatgatatcacaaataaaaaatagaccacttcagtttaattttttactactttctcataaagggaatagtaagggtcaaacttttcctactgcttctattatgatagtcactaattatatacagttgatcccattcatgaagaaagctaaatcacctatgaaaataaatttcattttattaaaaagtatgaaaaaggctaaaagctttgatagaaagctactaaaaatataaattagcagtccaatttcaagctaataagcagaatttttttttttccaagagagagggcctagctctgtcacccaggctggagtgcagtgtcgtgatcacggcatgctgcagcctcaaactcttggggtcaagggatcctcctgcctcagcctcctttagctggaactacaggtgtgtgccaccacaccaggataatttttttttcttttttttcttttgtagagtgaagctgttgctacattgcccaggctggtctcgaactcctggcctccagcaatcctcctacctcagtctcccaaagtgcaggtgtgatccactgtgcctggccaagcag

SEQ ID NO: 204155 - DNA, 601 bp, Human
tgcagctggtatcaacaactgcccttttttatggctcagtaaatgcttcttttgcacctattctggcatctcttcttttagcctcatactaacctcaccccaacaaatttctgagtcctttagagacttgttcccctgggtgtcctatgcaatcctgttccataaaaactcagttctcctcttttcctcactgtgtgcaaagagtgtgatttaggataaagaaggtgatttccttgatatgcaagcatttcagtctcagtggctacaaagatccattttcattaaattgcaaaagggacarctcagttaaagatgatgatgatgatgatatcacaaataaaaaatagaccacttcagtttaattttttactactttctcataaagggaatagtaagggtcaaacttttcctactgcttctattatgatagtcactaattatatacagttgatcccattcatgaagaaagctaaatcacctatgaaaataaatttcattttattaaaaagtatgaaaaaggctaaaagctttgatagaaagctactaaaaatataaattagcagtccaatttcaagctaataagcagaatttttttttttcc

SEQ ID NO: 204156 - DNA, 601 bp, Human
acttcttccttcagcatcttcttatgtgttcctcatttaccaagctctgtgagatttagcctacttcatcctgccttttgaccctttgaaaattggtgactttttcattatagtcacctttttcctctatccatgttaagatctaagggtcaaaggtgtacatgctattctagatagatttgtcagagatgcatagcgacccgggacctccttgctttctgccaggaaggaatgtctggcataaaactctggttttatacctcaaaatgtgaggagtatgaggttttggacagaaaacacrttatccatgacaatgctatgggtagtagatgtactgcagctggtatcaacaactgcccttttttatggctcagtaaatgcttcttttgcacctattctggcatctcttcttttagcctcatactaacctcaccccaacaaatttctgagtcctttagagacttgttcccctgggtgtcctatgcaatcctgttccataaaaactcagttctcctcttttcctcactgtgtgcaaagagtgtgatttaggataaagaaggtgatttccttgatatgcaagcatttcagtctcagtggctac

SEQ ID NO: 204157 - DNA, 601 bp, Human
aacagatgcaaagtaggaagcacaggaaacattatatagagtacttgcaagaatgtgtgttgtaaaagtgcaggccataatgattaatgctttctggaatccccacactccctgctggtcttgcagggcccatcacatatgaaaagacatccgctatcttatcagcatatccttacacaagtctcatctttgcttctcctgtgttcattataggtttctttcttttgttttcttttcttttctttttttttttttttgagacagagtcgctctgtagtctaggctggagtgcagtggcgcratctcggctcactgcaacctccacctcctgggtcccggttcaagcaattctcctgcctcaggctcccgagtagctggtattataggcatgcaccaccgtgcctggctaatttttgtatttttagtagagacggggtttcaccatgttggccaggctggtcttgaactcctgacctcgtgatccgccggcctcggcctcccaaagtgctggaattaccaacgtgaaacactgtgccctgcctcattataggcttcaacctaacacatatcactttcattctctggaatgaaatacctgcaa

SEQ ID NO: 204158 - DNA, 601 bp, Human
cctgatttaagcagataacagtatctatttcataggattattgtgacaatcaaatgagtaacagatgcaaagtaggaagcacaggaaacattatatagagtacttgcaagaatgtgtgttgtaaaagtgcaggccataatgattaatgctttctggaatccccacactccctgctggtcttgcagggcccatcacatatgaaaagacatccgctatcttatcagcatatccttacacaagtctcatctttgcttctcctgtgttcattataggtttctttcttttgttttcttttcttttctttttttttttttttgagacagagtcgctctgtagtctaggctggagtgcagtggcgcgatctcggctcactgcaacctccacctcctgggtcccggttcaagcaattctcctgcctcaggctcccgagtagctggtattataggcatgcaccaccgtgcctggctaatttttgtatttttagtagagacggggtttcaccatgttggccaggctggtcttgaactcctgacctcgtgatccgccggcctcggcctcccaaagtgctggaattaccaacgtgaaacactgtgccctgcct

SEQ ID NO: 204159 - DNA, 601 bp, Human
tcttctgtctttcaatttcctgccagtacctagtatcagcctgatttaagcagataacagtatctatttcataggattattgtgacaatcaaatgagtaacagatgcaaagtaggaagcacaggaaacattatatagagtacttgcaagaatgtgtgttgtaaaagtgcaggccataatgattaatgctttctggaatccccacactccctgctggtcttgcagggcccatcacatatgaaaagacatccgctatcttatcagcatatccttacacaagtctcatctttgcttctcctgtkttcattataggtttctttcttttgttttcttttcttttctttttttttttttttgagacagagtcgctctgtagtctaggctggagtgcagtggcgcgatctcggctcactgcaacctccacctcctgggtcccggttcaagcaattctcctgcctcaggctcccgagtagctggtattataggcatgcaccaccgtgcctggctaatttttgtatttttagtagagacggggtttcaccatgttggccaggctggtcttgaactcctgacctcgtgatccgccggcctcggcctcccaa

SEQ ID NO: 204160 - DNA, 601 bp, Human
ctttgttcctctctctcactttacttttccccctcaaaattcccttttgccatgaatgatacataggtggccaacatgctccttgctggagttaaagaatcatgaggcttctttcttctgtctttcaatttcctgccagtacctagtatcagcctgatttaagcagataacagtatctatttcataggattattgtgacaatcaaatgagtaacagatgcaaagtaggaagcacaggaaacattatatagagtacttgcaagaatgtgtgttgtaaaagtgcaggccataatgattaatgmtttctggaatccccacactccctgctggtcttgcagggcccatcacatatgaaaagacatccgctatcttatcagcatatccttacacaagtctcatctttgcttctcctgtgttcattataggtttctttcttttgttttcttttcttttctttttttttttttttgagacagagtcgctctgtagtctaggctggagtgcagtggcgcgatctcggctcactgcaacctccacctcctgggtcccggttcaagcaattctcctgcctcaggctcccgagtagctggtattataggcat

SEQ ID NO: 204161 - DNA, 601 bp, Human
agctggcaaattctttgtagttatcaaataggaaatgatataagtgtgatttccaaatagaaaagtagctgtgaaaatgtggggcgacatgctttgttcctctctctcactttacttttccccctcaaaattcccttttgccatgaatgatacataggtggccaacatgctccttgctggagttaaagaatcatgaggcttctttcttctgtctttcaatttcctgccagtacctagtatcagcctgatttaagcagataacagtatctatttcataggattattgtgacaatcaaatgagtaacagatgcaaagtaggaagcacaggaaacattatatagagtacttgcaagaatgtgtgttgtaaaagtgcaggccataatgattaatgctttctggaatccccacactccctgctggtcttgcagggcccatcacatatgaaaagacatccgctatcttatcagcatatccttacacaagtctcatctttgcttctcctgtgttcattataggtttctttcttttgttttcttttcttttctttttttttttttttgagacagagtcgctctgtagtctaggctggagtgcagtggcg

SEQ ID NO: 204162 - DNA, 601 bp, Human
actccaaaattattagaagtgataatatatccaaccagaaaattccattttccagctccatcttatcttgcacattcaccctcctctaacaattccaacacatcagagtcttccacctccaccccattagcctcagtcaatatccaagttcacattcctatggacaggctcatcctacactgcaaagaatctgcttcatgcagctgtctttatggcagctggcaaattctttgtagttatcaaataggaaatgatataagtgtgatttccaaatagaaaagtagctgtgaaaatgtggggygacatgctttgttcctctctctcactttacttttccccctcaaaattcccttttgccatgaatgatacataggtggccaacatgctccttgctggagttaaagaatcatgaggcttctttcttctgtctttcaatttcctgccagtacctagtatcagcctgatttaagcagataacagtatctatttcataggattattgtgacaatcaaatgagtaacagatgcaaagtaggaagcacaggaaacattatatagagtacttgcaagaatgtgtgttgtaaaagtgcaggccataatga

SEQ ID NO: 204163 - DNA, 601 bp, Human
tgagaaacaaattctgaagcccacttatcctgctttaaactccttcgtaaaacctgccccaactgggaatagccatttttttttttcctctgacttcctggcagcaaggagggagtctagtagtaaggacataaatcttatctgacacttctagtttgcaactcagcttagttattttcactgtgatcttgaagaagttacttatcttctccatgctgctgtttccacatctgtaaaatggggatattacttcttctctgagactgttaggaggatggaattaggtaatgtatttcaaggrtatttctcaaaatttcattggtagattatctgcttcagaatgagtggcgctgccagttacaaattcagaagcctgctcctcctaggatccaattattcaaaagtgctgtgggtgtctcccagaaatctagatctatagggaggggcctgggtaagtcttctgcatactattgtttgagcatatctgtcataagcatcgattaccatcactaccatcataatgtatataccactcattttctaccagtgaccagtctccttggattccgtgccttgtatcactgggtatttgctataaata

SEQ ID NO: 204164 - DNA, 601 bp, Human
gccagtcagcactgaatctttattttatagtgggaggcaaatgcctgggggaataagtacttccagctgattcactggtacagtagcatttttttttattatgaaatggtaaggtctaaaaagtttttgaataaatatctaaaggctctgaaaaatgtactatggtggcaaatgtctacccagacagagtgagatatcacagcctctttccctagtcttttgctcttagattggttctgtgattcaggcatcatcttgaaacttctctggttctgttgaatgtccagttccattcaccacscataatttattaactcaagggttgagatgacctgacaggaatgtgaaaggattgtgatagtcatcagtaatgattggaccagatgatctctgaaaacccttctaatctggagaatctgtgtagctcagctcttatctcatgagccatccccttggcctggtgtttgcccttcccaaacttcctatatgttcctctgtctataaaaatgctctccttcccatttgatgggccctaggatacatctttaagctcggtttaaaaactcagtgaatgctcaattcttgctactcaaaatatgga

SEQ ID NO: 204165 - DNA, 601 bp, Human
agcgtcatggaactgagaaataacttgttatgagatttcctgctgaacaagccttaaaaagcacagtggagcattcccacataacattcttttgtgccactaagtgaagacccttgcttggtgattctacttggacttcaagactataaacatatatgtccagttcatttcaaagggaatgagatggagacccaggaaggcggctagatgaggaccatctcgcagatgtcactgtttcttgatgatggacggtattttgttctttgtctctgtgttgttgcttcatgtttggccataaatkatcattaatctatgtggctaaaaatgtgtggctatattcttaaggagctctcagcccctgctgcaatagtgagcagtaatataacgtattgagctaattgtaattcattaaatagaatccacctgcaaacacatcataccaaacacaaggccatggctacctggtggcaagaagagggtatgtgtgaactgggctgaaccaggcttccttcctccgtggcatgctgtcatagattaaaaggtctttctcagtcagcacaaccagggctggtttccactgtttcttgctctcccctggcac

SEQ ID NO: 204166 - DNA, 601 bp, Human
atttatcaaattgtatacattaaatatgtacataactttgtatgtcaataccgtgatgaagtgctttttaaagacatatttcacatgaataataaatgtgcactgaaggacctgaaaaaccgagcctggcagccacccttccacaggaagcgtcatggaactgagaaataacttgttatgagatttcctgctgaacaagccttaaaaagcacagtggagcattcccacataacattcttttgtgccactaagtgaagacccttgcttggtgattctacttggacttcaagactataaacayatatgtccagttcatttcaaagggaatgagatggagacccaggaaggcggctagatgaggaccatctcgcagatgtcactgtttcttgatgatggacggtattttgttctttgtctctgtgttgttgcttcatgtttggccataaattatcattaatctatgtggctaaaaatgtgtggctatattcttaaggagctctcagcccctgctgcaatagtgagcagtaatataacgtattgagctaattgtaattcattaaatagaatccacctgcaaacacatcataccaaacacaaggcc

SEQ ID NO: 204167 - DNA, 601 bp, Human
tatttttgggctctccaatctgttctactggtctccgtgtttttatgccagtatcataaggttttgattattataggcttgtaatacagtttgaaatcaggaagtgtgatgcctctaaaggtccgtctatagatgaacggataaagaaagtgtggtatttacatataattcaatattattcagccttaaaaaagaaattctcccatatttgacaacatgaatgaacctgaagaacattatgctaagtgaaatatgccagacacacaaggacaaacactacaggatcccatttatatgaggwatctaaaatgacgaagctcttaaagcagagagtagaatggtggtttccagcggggagagggaaatggggatgtgttggccaaagggcacgaaatttttgtcatgcaagttgaataagttctagagatctactgtacagcatagcgcctatagctaacaacatggtattatatacctaaaacgttgctaagagggtagatcttatgttacatgttgttatcacaaaaaataaaatatagaggaaggaggaaatttttggaggtgatgagtatgtttatggtatagactatgatgatggttt

SEQ ID NO: 204168 - DNA, 601 bp, Human
tcgaactcctgatttcaggtgatctgccctcctcggcctcccagagtgctgggattacaggcatgagccagcatacccggccatgattactgcagttttattacaaagctgtattttactttagtagccattctgccaaacattttgaagcttgaaagcttcaaatattaaattacttttaaattttattttttaaaggtgatctaggcctggttcctcacccctgaaaacctcctctattcacctctggagccaataatttccatctttagctccccacctccccggccccacccccgckgctggtcttcattatcaatcatgactggaagtaagaaggatttttctggaatttcagctctattcactactggcattttaatcttgtgttaattcttgctctgctactgggtctcattctcctccttgcagccagctgacccttgaccataacctgtttggcagctcagtccttcctagatgaagagcccaccttatttctgtctacatcttgctcaggtcagatgctccaaaacctctgtccactacgctttgtctcttggaccaaacttcttccagagtttgtctcacattgttcaat

SEQ ID NO: 204169 - DNA, 601 bp, Human
tctaactgggccatgcagcagtgcacgagctctgtgcttggatcttccctaagtctggaatgctcatgcccctctctgggctcccttcccttgttcctctggtgagttttccctcaggcttcaattcaacatgacttctactgcaaggagtcctccaccactgtccaggcagagtttggcattttttgttgtctttactgcaaatggttccttatgtgttcctgcacatcaacacactttgttccagataatgctaggttcacaagtttgaatttttttcacctctttatcccttgtcccrattataactcctggcacatagtagatgatttataaatgttgactgatgaatgaatgaatgaatgaaaaagcagtccccattgttcataatgcccagaaactgtgagaacaaggctatgtacgagggtaaattttattttcatgttgcctgagagttgcagaaactaccttatttcaacttttgtttctgagaatcatttcaagatgcttgggtccaactttgcttcttagtaactggaatccagtgactgtggtctaatctttctttggtttctgttgcgggaatgtctcagaatctgaa

SEQ ID NO: 204170 - DNA, 601 bp, Human
caagtgacacacagtcccggaactggaatcccacctccatctctcagaagctacaccacctggggtgattcctgaactcttttgagcctcaggtacctaatctgcaaaatgggcacactaataccggccttgcagaatggatacacacgttgtaagtggtaacttgtgtcaagtgctgggtacttagtgagtatctgattcatttcccctcattccccagggccgtatgtggtgctctaactgggccatgcagcagtgcacgagctctgtgcttggatcttccctaagtctggaatgctcrtgcccctctctgggctcccttcccttgttcctctggtgagttttccctcaggcttcaattcaacatgacttctactgcaaggagtcctccaccactgtccaggcagagtttggcattttttgttgtctttactgcaaatggttccttatgtgttcctgcacatcaacacactttgttccagataatgctaggttcacaagtttgaatttttttcacctctttatcccttgtcccaattataactcctggcacatagtagatgatttataaatgttgactgatgaatgaatgaatgaatga

SEQ ID NO: 204171 - DNA, 601 bp, Human
tgaattgttaatttcacttaaatttaattactttaagtagccacatctggctagtggctaccatgctaagcagtctagctctcaagacccctgtaaggtcaggctgaggctgagactttgcctgaaatcctagcctccttggctcctctctctttttgtccttcccctcctcctttccaggcttctcctgggagcatttgcttaagaactcactgccacttcagtccttgttgccttctctgcttctgaagaaccagaccaaaggcagagcctttctcagtctcctcatcttaccaggggkttgaagtcccagggctaaacctggttacaggataggaaagctgagaaaaaaccaaaagaggggagactcctggggagcaacttatctcttcctgtagctaagtactttgtgtcctcacagaaatttggttttatttttatttatttatttttctttacaatggaatcaggatcactgcaaaattggattcagcagtcactccttggacatttgttatttgacaccaaatataaaaatatctacccagatcacatccatgactcttatcatccccaaagactcctgctgttccccatggtt

SEQ ID NO: 204172 - DNA, 601 bp, Human
gcccagcccgcatcttctattctaaatgatcacagtgatgcactgaagaggtttccatttcctgtttgcatattggatgcaggcttatgggtttaggctattcatctgctttactctcagttcagacctggcacccctgtcacttgtgaacctgtagcagacactttcagtgctccactcaaacctcttcagttcccatttactgtttctgcacatccatctctccttctgggcctttgcttttaaggaatcacacttaggactttcctgcttgtgcagaagcctgaagagcctgcgagaygacatctctccaggcagcctcagctgtccatggactgctgtaggaatgtacagctccagtcacttgcctgagtcgggacaaacttggaaggagtcatttacatgctctaggaaagtgctgtctgatagaattttggtggtgatggggatgttctagatctgtgctgttcgaaatggtagtcactagccacaggtggctattggacccttgaaatatggctaaggagggtgaggatctgaattgttaatttcacttaaatttaattactttaagtagccacatctggctagtggctaccat

SEQ ID NO: 204173 - DNA, 601 bp, Human
aaaattacaccatacctttatgatttgtgcatattactatttataaattagacctcaatacaagatttttaaaataaatttttaaaaacaggaatggatcctcttctttagaaatatacaaagacaaataatactactagacagattacatacttatgtggtcatatataaaggacacggtgctgtatatggctgtatagaatgcatcggaagtaaatgaaagagtcacttgttgaacttagataagtggctaaaaaagcagtcaatggaagtgctggggtaacctctgcaatggaaggaytctgtttccctttgaatgctaccatttctggcatggaccatcccccacaacccgccagaaaccaacagcatcagcccagcttcccacctcagagagccacctttatccacaaggagataagagtttctatttcagctggggtggaccctgcctcctactgcaattcattgggaagctcagcctggagctgcaaaggggctacatctccctggcatcatcccacagagaaggcaggggacatttttttcccattgtttgctttctaaaagtctttttctaggtacatccacagggtcttgg

SEQ ID NO: 204174 - DNA, 601 bp, Human
tttttaaagagacagggtcttgctctggacccaggcgctggagtacagtggtgccatcatagctcattgcaaccttgatctcctgggatcaagcaattctcccacttcagcctcttaagtcactgggactacaggtgtgcaccaccatgcatggctaattgttttttattttttgtagagacggatcctccatgttgcccaggctagtcttgaacttctgggctcaagcaatcctcccacctcagcctcccaaagtcctgggattacagcccagcttgatctattttgaaaataatattaycatggccttcttgataatattacccaaggtgattagttagtagacacagtataataaattttttaaaaacatagctctatatccataagtaaaaattacaccatacctttatgatttgtgcatattactatttataaattagacctcaatacaagatttttaaaataaatttttaaaaacaggaatggatcctcttctttagaaatatacaaagacaaataatactactagacagattacatacttatgtggtcatatataaaggacacggtgctgtatatggctgtatagaatgcatcg

SEQ ID NO: 204175 - DNA, 601 bp, Human
tgatgacctgtgaattttagttggttacaaattttcagtgtgatggagttgttttaaaaatgtagccaatgtatttataaacccgaaaatagaagaggggttaacaaattagaaaatactaaatttatttagcacttgccatgtgtcaagcactattctaagcagtttacatgatctagtgtaatccttataacaaccctattaggcacgtatagatattgggcacatattactgatgaaggacttgaggcaaaaagagattacaaaactcgcccaaggctccaaggcttggtaagtagcraggctgggattcggagccaggttgtcagtttccagaacccacgctctggagcattcgtgtgatggacactatgcagccatgaaaataaagctaggaaagaatgcaaaataccagggaaaatgctagaaggtcatctaagtgaaaaggaagggcagcagcacatcacattttaggagctgttgatcactctgtgagggccgggacccaggacagccttagaactgatccactggtggtcatcacagcttgtggccaaacagcgcttctgaagaaccacggggtaagaagaaccacatagtt

SEQ ID NO: 204176 - DNA, 601 bp, Human
tcccattgtgtgtgtagaatacacagtataaaaagatctttagaaatgtctccatgtatggtaatgactaaaatcagtcctattttaatggaaaattgaaaccatgaacaaataacctgaacaatcagctcttataacactcggcttttcctctatttcataccgcctccagatattctcctaccatcagccctggctactatgttggccactaataggagcctatcaagtttctctaactgaaatgaacattcctaccccaaagaggaaggcatctgcaggcctcctgtctgtggagctsttacaaatagcatttagagatagctctgttgtgtgtgccaaggagttccagtctcccgactccatcctaccctccccaaacccatccaaacagccaacaagttcattaacctcagtccttagagctcgattactgtgatttaagacactgggattcccagataaaatgcagagtcaaatatgtcaaagtacttactttaatttcaattattttctctggtctttaacaattgctaacatttatcaatcacttatgtttcagtcatatgcttaatatttacatatgctatctcaatcagtc

SEQ ID NO: 204177 - DNA, 601 bp, Human
aaatgagggtcaaagaatcactaacaagtaccaaattgtcaggtgagaggggtttcccaggaacactctctaactccctgcatcatttcccccagctaggagtagccaatcaattgcctcatttatatcttctaacctcctttcatctgggccgggtgcggtggctcatgcgtgtaatcccatcactttgggaggccgagtcaggcagatcacctgaagtcaggagttcgagaccagcctggccaacatggcgaaaccctgtctctactaaaaatacaaaaattagtcaggcttggtggcrggcacctgtgatctcagctactcgggaggctgaggtaggagaatcgcttgaaccctggaggcagaggttgcagtgagccgagattgcgccattgcactccagcctgggcgacagagcgagacttcgtctcaaaataaataaataaataataaataaataaataaactcctttaatctgaatatggtagtgaaaggcaagatcccatgtctcagaaagttgatattgagggatattgactataagaaacgaacaacttagtacaggtgaataagcagcaaaacagcttggagtcaattcct

SEQ ID NO: 204178 - DNA, 601 bp, Human
tagttttgaacaaaacaaaaaatccccaaaaacctgtctttcaagaaatgcttttgcattaatttaattctggagaagtatcagagaatgttgcataaaatgttccatacaaaagcattattattaatatccttaattaaaacacaaacagttacagcacacagattcagccaaattagtaaaattacatattaggtaactgggttgctaagcaatattacatcctcattttacttaattgctgtaattagcatctcccagcagatgccacaatgcaagccacaaaaaaaagaaaaaaaaacaactggccagattgcttacatggttctggcgagctcaaatactttcatccactggccacccctaatggagtctgggcgtcaagagacccttcaggaaagaaatgagggtcaaagaatcactaacaagtaccaaattgtcaggtgagaggggtttcccaggaacactctctaactccctgcatcatttcccccagctaggagtagccaatcaattgcctcatttatatcttctaacctcctttcatctgggccgggtgcggtggctcatgcgtgtaatcccatcactttgggaggccgag

SEQ ID NO: 204179 - DNA, 601 bp, Human
ctcaactgcaaactggggataataatatggtcacctcatggtggtgttgtgaaaattaaataaattaataaatgaatattgcatggagcagtgtttggcacagaatacatagtaatagtcattattgtcattagaacataagtttgatcaaggtagaaatttttatttgattattccctgctgtattcctagcacctagaacagttctaggcacatagcaggcactcagtatctgttaaatgaatgactaaatgaataactagaatataaagagaacaatttcccaagaagtttgtgattratgactactacatgactcctctcccactctcagcccttcaaccaaacaaagcagtaactaatgctaaatccaaagaacttgggtttatgtccactacatgctaatttccagattaattcagccctgaaaaaaagtgatcttgaaaggtagctgagattagatgttttatgagaacagcctaacatccatttcctgcttcttcttttgaatctatctttagtgactggtgttttcggtagtaacttggttgtttagggaggtagagttaccttcttttggtctgggggatagaagttgcct

SEQ ID NO: 204180 - DNA, 601 bp, Human
aaatggagatcagtgattatggcacaaagacaaagaaggaatctcacatttatcaacatatttgttatttcatccctattaaggtgttggaaataatagatttcacttattctttatatcattcccaatgaattgcttctgattatcaacaataataagttggggatgaaacataggaatgtggacattcatcactatactaccttatagtgactgaacagacagctgattgctgtacatattatggtattgcaaagatgagtcaaggccatcagacaagataagattaagatcctttctyttttgttatgtgagccagcagggcaataggagtagcgcctccagaaagaaatagagaaaactagtggaataattcaatttataaatgctctgtgaaatctttctcttgagattaatttgcattggcatattaccaactcccagccaataaataatactggatatacaatgttggatactgtctatctaacagcctgcttactgatcatctccactctgatggctcacaggcatattagactccagataagctacagtcatattgcataaggcctttaagatcttaagaacccaatacttg

SEQ ID NO: 204181 - DNA, 601 bp, Human
cagagaagcttcttgctttgttcaagtcctttctcccttccttacaaaagaacaccaaaaatcactcgctaattcattcattcattcaatcaatcaataaagatttcttcattcaccaagtgatatactcaacaaatatttatggagcactgttatggactgaattgtgtcctcataagatgcatatgtcaaagcccaatatgacagtatttggaaatggtgaagtggctaccttgcctggggtatatccccgccaggaatatccggggttgtcccgcgccaggaaaatttagaacacggrcatacactaggagtttaggagtggaggtttaataggtagaagagaaagggaaacagcttcttctatagagacaggggtctccgagcagaaaggaccggttggcagccaatgtgctgaattttatagtccggtttgagaaggcggtgtctgatttaggcaggactcacagattggttccatcaggtatgacttttacatactgcagggaagggctgcttgccctaccctaatcttcttatgcaaatggactttccagttgatctgtgccatcttgtctgcttcttgctgtacacgtggccg

SEQ ID NO: 204182 - DNA, 601 bp, Human
caggcatggtgcctcacacctgtaatcccagcactttgggaggccaaggcgggcagatcacctgaggtcagaagtttgagaccagcctggccaacatgcggaaaccccgtctctactaaaaatacaaaaattagcctggcatggtggcatgcacctgtagtcccagctactcggcaggctgaagcaggagaatggcctgaatctgggaggcagagattgcagtgagctgagattgcaccactgcactccagcctgggcaacagtgcgagactctgtctttaaaaaaaaaaaaaaaaaaaaagagagatatggaagttctgtgaatctcattgagagtagagtctaggacagtgtgaagggaaatgactgctggcatgggtgcccacacaaggggatttaacatgtagagattaagctcaattcattcaggagggaggagggcattttataataagtgagcaagagtcactgagaagctgctagaggattcaaatgcaagtgaggctaaagaaaacagaaagcatttctctgaagcctagcataggctttaaagggagtaagggtaaggtaaaaattcattaagaaaaggtatctacaagga

SEQ ID NO: 204183 - DNA, 601 bp, Human
tggatgttttatcccctccaaatctcatgttgaaatgtaatccccagtatggaggtggggcttggtggaaggtgtttgggtcttgggggcggatccttcatgaatagcttggttccctcctcctttcagtaatgagtgagcccttgctttgaattcatgagagacctggttgtttaaaatagtgcggcactttcctctcctctctatctctctcccctctcctattgccatgtgatatcccatttgccttccatcataattggaagcttcctgaggtcctcaccagaagcagatgccaggmccatgcttcctgtacagtctgcagaactgggagccaaagtaaacctcttttctttataaattacccagcctcaggcatttctttatagcaggcctaaaagactcacacacctgttttctgatcaatcctattaactgcctaatatatttccaataattttattctgtgatagattactcggaatcagtttctgttgtttgtaaccaagagcactactcattcatgcctcaaagttcattcctccaggaagccacccagaggttacaggtaggaaaactgtaactgactatccaacttacc

SEQ ID NO: 204184 - DNA, 601 bp, Human
ccagctagctcacttcacagaattatttcctattctccactgattagtctatcaatagctcgtgttttcttgtcaaagcagagttcagcttattagagaaagattttacaaaatttgtagaatgtaaattaagccaaatccctttgagcatcttcattctttcctacaacactccccaaatggttgcacagggtctgaacttctctgttattacacatgtaaccttattaaacttagtattcaggtggctcaagcttcttccaactctcaagttcaaaactttttttttttttttttttttgccattcagagtaggcatcaaaaataaaagcttccaagatactcctacaagacttcaacaatgatgggaaacatttgaggacactaattagtttcaggataattacaaaaaggcactgattatcttggatatgttgcaatagaagttctgcaaaacatctcatttttcatgattgcataaacagaggaaatttggaaaaaccctactacatgttaacacatgccacatctttcagaatactactgggtgggaccagatgcagtggctcatgcctgtaatcccagcactttgggaggccga

SEQ ID NO: 204185 - DNA, 601 bp, Human
ggtcatttccatacttacttctccaccacccagctagctcacttcacagaattatttcctattctccactgattagtctatcaatagctcgtgttttcttgtcaaagcagagttcagcttattagagaaagattttacaaaatttgtagaatgtaaattaagccaaatccctttgagcatcttcattctttcctacaacactccccaaatggttgcacagggtctgaacttctctgttattacacatgtaaccttattaaacttagtattcaggtggctcaagcttcttccaactctcaarttcaaaactttttttttttttttttttttgccattcagagtaggcatcaaaaataaaagcttccaagatactcctacaagacttcaacaatgatgggaaacatttgaggacactaattagtttcaggataattacaaaaaggcactgattatcttggatatgttgcaatagaagttctgcaaaacatctcatttttcatgattgcataaacagaggaaatttggaaaaaccctactacatgttaacacatgccacatctttcagaatactactgggtgggaccagatgcagtggctcatg

SEQ ID NO: 204186 - DNA, 601 bp, Human
gggaggcctccaaagtttccgggaagaaatagagatttctattgttcacagaatgcggtggctgttaatcgaagctctgattaaaacatatgccccttctccagactgacttgcagatatctttcgacttgtaactagggctgatcttttcatctaacaggtctataactccttctgcgcacagtccctgaaccctgccctccgccagccctcccattcaaggatgtctaaggacagtagcatagagattgtgctgatagcactgcctccctgtcttgacccctccattttttttttttttgagacaggggtctacgctatgttacccaggttggtctcaaacttggggctcaaaggatccttccgcctcagtctcctgagtagctgggattacaggcatgtgtcccatgactgactccattttgatactcttcatttctacaacccgcagaccatgtgggtgaatgggctgtaaaaatgatgttcttttccccaatgtttaaataaatgttaaagctataccttcagatattctgaattaactgattgtgattacttttaattctagttgacttcaaatggtatttttggagtatctgac

SEQ ID NO: 204187 - DNA, 601 bp, Human
aggttattaaggatcagattggatttttttgcttcacaaaacaccacatttaacagacctgacaagtaaattggctcaggttttgatctacatctaaaagttatgtagggaaaccagcacactcactgctggggatggggcttggaggcataagagcaagagctttattgattcagaacttgctgtacatcatcatttactccactcagctttataaaccacacacttctgaagctggaacacggcccaatattataggtggaaaaaggaaagctcagagaggtgaacacatcactacccrggttgtttggctttcaaaattcaaattctttccactctgtcctgtgtcccttctcatgctctggcactcaggacaaggagggatgtggggagagagctgggcacagagtcgctcagctttcctacctcatgaataatgacagtaggcggggaggcctccaaagtttccgggaagaaatagagatttctattgttcacagaatgcggtggctgttaatcgaagctctgattaaaacatatgccccttctccagactgacttgcagatatctttcgacttgtaactagggctgatcttttca

SEQ ID NO: 204188 - DNA, 601 bp, Human
cagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagrgtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaaggtaattcaacagtggcgggacgggggacaagcgttcggtgcctgtcaccttcgccaaggccattacc

SEQ ID NO: 204189 - DNA, 601 bp, Human
cacatgcacccccaggatacccctacacgtcactatctgaactgggagctgggggggggtctcgtctactgcagcctgccacagcggatgccaagccccctgcatgcccccttcacaccccgccccgacccagcccacagcctcttcgacaccttacccagaagccagcctctacccactgccactttccctgtctaccaagggcccatgatgggcacaagacactgctggctacacagatggctctgcccagatgcccaggagcccagaaccaacttatgatgcacacacaacaacccamaacctgacccaggctctgggagcagcacagggcatcagggaagacccccaaggaaatgattcaaacggctcgaggaggaggaccagccagagtgcaagcttccccaggactagacatgctgagcagggagggaggggaacccaggagccagttcccaaggaagtctggcaggccaggccgtgcagtgaggtgcccatggcataggcagaccaccacccacccctctgcatcgccctcaagggctgagccactcaggctcctgccagcagtcatcctgcacctgggatgagggaccctgcc

SEQ ID NO: 204190 - DNA, 601 bp, Human
tgctggggcagccacgcccacagcaaggacaaggtcacttggcaccaaacggccagctaccaggcgccaggccacagtacccactgactcctccaggagccactggacgcagcttggacgatctggactggaaagacctctgagcagggaagagatcagcctgggcctgtggatctctctgcccagcccctgctggcacccaggcaaccatgaggggcccctggccccagtgaaccagaagcctggcacgaggatcagcactgggaggaagccctgggttgggcctcaggctccgcaacamctaatgggaaccggagcttggagagcaaaccaaagtgccagccacaaggcggctgagcgggcactgctgttcaccagctacttggcacagctttgagtttaagggggaaggcgctgctcatggcttcagtctgggcatggcccccaaacagcagggcagggcagcccacacgacacacttcccagttactgccccctctccccaaaaggcaacagcatttgttgcacataacccgccacgctgccacgcaggtgagccccaagtcaggcaggtccccagggcccttggctcactctcagc

SEQ ID NO: 204191 - DNA, 601 bp, Human
tttcattttttttttgaaggaaaatttgtattattttaattattttaatgtacagaaaactcaacagtgtacatttaacccagtttagtggcaagttctttagcctttgccttttcgagcttggcgatacgagccacagacttaggacccaggatgttgccgccccagtgacggcggatctcatcgtatctgtcattgtaattggtcctgatagcttccatcagcttagccaaagtgcctttgtcttccgagttcacctatgtgaaggtgacagtggtgcaggtcttcctgtggactagaygtcccagtcttgccttccccttgataatgcagtaagggacccccattttacgacacaaggcaggcaagaagacaaccagctcgatgggatccacgtcgtctgcaatcaccaccagctgagctttcttgttctccaccaaggtggtgacgatgttaactcctgctcgaaggacaggtggtctcttggtggggacgtcccgtttgccagcagctttcttctcagcccaggccaacagtctctgcttcttctcttgctttgtctctggtctgtacttgtgggccagcttaagcagctgagtag

SEQ ID NO: 204192 - DNA, 601 bp, Human
cggccggccctcgctctgccgcccgcccgcgtgcgtttctcctctctctctcccagacgttcttttcctaatttgttattttacctttgtcgtcctcatttaaattttccctcccgatcatcttttttcttcccctatctctgtagtttctctttatttctgttttactttccgcctcttccccttttcctccatcctcgccttccttttcactttatttttaatcattctttgtctttcttttagtcggtgcctttcctcttatttttgtatgtcctttgttttttatgtttttcttttwaaaaaaaaaaaaactaaagtctttcctttttttcttttttatgacttcgctttctgtcttaaattttcccttcgttttctctcttctctttcgctcttgctttttattgccttttcgtgtccttctgtttctcccctaccttcttctttgggttttttgtgttttctcccctttgctcaatttcgtctccacggcttcctcgaggctttctctccttctgtgaaactctcccgctctctcctctcttattaactttcctcccccctctccaggctcacggccacctctgctctccttccc

SEQ ID NO: 204193 - DNA, 601 bp, Human
gggtgagagaaggagggcgacccctctcccagggcccaggcccactaggctgtgcgacccctgaccagaggccgctctcctcatcggcacaccagcactgcccaagctccgcctcagcctctagcctcgcagggactctaaagggcctcctcggggacagcccagagccgcctggggacagccgggggcctggggattctacaggcctcttagggacaggcgggtgcctcgggactcgaggccttgggggacaccggagcctggggaggcagtcgctcacgtggccgttgtcgtccagtargttgttggtcagcttgagcttgtcgaaggacacgatttgcttcatccactgcgcgcccttggcaggcgagtccgggtggtagtgcacgcggcctggcgtggcagggtcggccttccccgccaccagccaggaggagctgtggaaggcgtacctggagcggcacggggtggggtcgtgcatgtggaggtgaacccagagggccttgacccgtgtgctgggcgaaccctaaaagtgcctttgagaagtttccccacctgtgagattgaaccctctgctgccgcatgtgctgggagcttttcc

SEQ ID NO: 204194 - DNA, 601 bp, Human
ggtgggggacagagcctcggccacgtgcacttcccgttcatcttgtgtccaagtcagcagccttggcgctgaccggctgtcagcccttcctgcttgcgctcaggaagggagggatcaaagagttcctctcgccccatccctggtgttgagttaacggggagaggtcccttagccacctggcctgggaaaaatgcttcatacacaggtctcaagatgactcatggctactgtcattgtgccccctggccaggtcactccgtagggacactcacagcaaataaagtcactaaggagggaacaygcgggcctgggctaggccggcaggggaaatgctagcagaacagtgctgcctgtttttgtctttccatgaccccatcccggtcaggggcttctccccctcccagcaccgaccggcagtgtctgtcatgacccttcttcccagcttccatggaaaagcacaagcatctgtcccgaaaacaggccagggcgcaggcccaagtcccagaatagggacaactgcaggtgggaggaatttaagtaaaaaggcaggatgcacacctgggcggtaccaccagccctggggaggttgggatgagacggg

SEQ ID NO: 204195 - DNA, 601 bp, Human
ctagggaacctggaggaggatgtttgggggaagtccaacagctgagggggagcctgtgggggaacagcggtgggacgagccccctatcccctacaccatactgcccatcacagcagcttacagaaggggcagggcaggtgtgctcaacggggaacctaaaacagggaacaagaaggagatggaagaacggccactgtcagtccagtagtgcagctaggacaaatgaccataggcccggtggcttatcaacaatggacagttatttctcccagttctggaggctggaggtctgtgagcagcrtagcactcaactaatcccactcatgaggactccacgctcgtgacctaatcaccgcctaaaggctccatctcctgccaccatcaccttgggggtgaacgttcagatcacagctgtcacagaggaagctgctggaagccaggccttagggcagctgcccatgggaacgtcacctccacaggaacggtagtggctggggcatcagccagacagcccccgcagcgggcaggcaatcactgggcactggttgaggactgagcacatgagggacggtgagcagcggcgtgcgccagtcttgcagac

SEQ ID NO: 204196 - DNA, 601 bp, Human
ggctaggggagggcaacggggcctctggaccagctagggaacctggaggaggatgtttgggggaagtccaacagctgagggggagcctgtgggggaacagcggtgggacgagccccctatcccctacaccatactgcccatcacagcagcttacagaaggggcagggcaggtgtgctcaacggggaacctaaaacagggaacaagaaggagatggaagaacggccactgtcagtccagtagtgcagctaggacaaatgaccataggcccggtggcttatcaacaatggacagttatttctyccagttctggaggctggaggtctgtgagcagcatagcactcaactaatcccactcatgaggactccacgctcgtgacctaatcaccgcctaaaggctccatctcctgccaccatcaccttgggggtgaacgttcagatcacagctgtcacagaggaagctgctggaagccaggccttagggcagctgcccatgggaacgtcacctccacaggaacggtagtggctggggcatcagccagacagcccccgcagcgggcaggcaatcactgggcactggttgaggactgagcacatgaggga

SEQ ID NO: 204197 - DNA, 601 bp, Human
ccctggggtcctagaacccttccgtgggatgcagtggtgtgaagggggtgtggatggtccccacccccgcttagtcaagaatctatctatttcctgcgttgtgcatctgttgtttttggagagtttttgggagtgaggagtctgggggcccttctggtctctcgtcctcctgagtcctggcagctggacgtctgcagccaggctaggggagggcaacggggcctctggaccagctagggaacctggaggaggatgtttgggggaagtccaacagctgagggggagcctgtgggggaacagyggtgggacgagccccctatcccctacaccatactgcccatcacagcagcttacagaaggggcagggcaggtgtgctcaacggggaacctaaaacagggaacaagaaggagatggaagaacggccactgtcagtccagtagtgcagctaggacaaatgaccataggcccggtggcttatcaacaatggacagttatttctcccagttctggaggctggaggtctgtgagcagcatagcactcaactaatcccactcatgaggactccacgctcgtgacctaatcaccgcctaaaggctcca

SEQ ID NO: 204198 - DNA, 601 bp, Human
tgtcttcctccgcagctcaaggtgccaccaaacagactcgccttgtcccgcagccaagcccccgcgtgctcctgcctctgcacctccagtgctttcctgggtgagaagcctctctgggcaatggagtgcccattgtcccttcgacaaaggggcacatgctgcagagggcagccgtgggggggtcttctgaaaacagggagcggggctactgcaggatcgtccagctgcacccccaggccctggggtcctagaacccttccgtgggatgcagtggtgtgaagggggtgtggatggtccccayccccgcttagtcaagaatctatctatttcctgcgttgtgcatctgttgtttttggagagtttttgggagtgaggagtctgggggcccttctggtctctcgtcctcctgagtcctggcagctggacgtctgcagccaggctaggggagggcaacggggcctctggaccagctagggaacctggaggaggatgtttgggggaagtccaacagctgagggggagcctgtgggggaacagcggtgggacgagccccctatcccctacaccatactgcccatcacagcagcttacagaaggggca

SEQ ID NO: 204199 - DNA, 601 bp, Human
cagcctcatacaactgtcatcgcatggatcccacacaccccatggacttccccagctggagggtgcgccgcagggtggggcctgaagcccaccaggccagggtctcatctccaccgggccagggtcttgtcttcctccgcagctcaaggtgccaccaaacagactcgccttgtcccgcagccaagcccccgcgtgctcctgcctctgcacctccagtgctttcctgggtgagaagcctctctgggcaatggagtgcccattgtcccttcgacaaaggggcacatgctgcagagggcagccrtgggggggtcttctgaaaacagggagcggggctactgcaggatcgtccagctgcacccccaggccctggggtcctagaacccttccgtgggatgcagtggtgtgaagggggtgtggatggtccccacccccgcttagtcaagaatctatctatttcctgcgttgtgcatctgttgtttttggagagtttttgggagtgaggagtctgggggcccttctggtctctcgtcctcctgagtcctggcagctggacgtctgcagccaggctaggggagggcaacggggcctctggaccagctag

SEQ ID NO: 204200 - DNA, 601 bp, Human
ttctccacacagggcggaggtcagcaccacagctgaagggaaaactgagtctctggaacacagagtctctggaacacgggccacatgctctcccctggtgcccagctcctggttgggttgcactgcctgacacactggagccatccctttcgtcctagaagcagctcctcacccatcactctccctccaccagtgagaggtgaggctgcctctgcccttggcaactgtggctacgtggaattctctggtatgcgggtgctttgatctgcggcacacctggagatcagggcctcagcctcayacaactgtcatcgcatggatcccacacaccccatggacttccccagctggagggtgcgccgcagggtggggcctgaagcccaccaggccagggtctcatctccaccgggccagggtcttgtcttcctccgcagctcaaggtgccaccaaacagactcgccttgtcccgcagccaagcccccgcgtgctcctgcctctgcacctccagtgctttcctgggtgagaagcctctctgggcaatggagtgcccattgtcccttcgacaaaggggcacatgctgcagagggcagccgtggggggg

SEQ ID NO: 204201 - DNA, 601 bp, Human
cttcagggcggggggtgaaggagcttggcaaggaggagaggcaggatggtgcagatgcttgtggaccctgcccgagcacaccgcctcattggaacccacagggaggagagaagcaggaatgaacgtccccgtgcccatggctgacacaggcctccactgttgacagagagcttctccacacagggcggaggtcagcaccacagctgaagggaaaactgagtctctggaacacagagtctctggaacacgggccacatgctctcccctggtgcccagctcctggttgggttgcactgcctgmcacactggagccatccctttcgtcctagaagcagctcctcacccatcactctccctccaccagtgagaggtgaggctgcctctgcccttggcaactgtggctacgtggaattctctggtatgcgggtgctttgatctgcggcacacctggagatcagggcctcagcctcatacaactgtcatcgcatggatcccacacaccccatggacttccccagctggagggtgcgccgcagggtggggcctgaagcccaccaggccagggtctcatctccaccgggccagggtcttgtcttcctcc

SEQ ID NO: 204202 - DNA, 601 bp, Human
aggagaatcgcttgaacccaggaggcggaagttgcagtgaactgagattgtgccactgcactccagcctgggcgacagagcaagactctatctcaaaaaacaaacaaaaaaactgttgagaggaactgaagctagaatgacagaggaatgaagaggagatggggaagactagggatgtgcagggaggagtgtcctgagaaatgatgtgaatgaagagtaaggtcctggaaggacagggccactgtaagggctggagacagaagccggagtcaccacctgcaagaaagtcacccagagcaasatgctggcacccagcgttgcccgaggccacagtgggcgcaccgacatgggcctcaactgcagcaccctggcaactgccactgcaccatggtttcatgtgcagccaagatccttcagttaggctgagaccccccactttgaataagagaacaccaacttcagaggtgttgaaatgcaggcaaaaaaccctgtgcacctcagaactggtgaaatggggagatgcaccccaaagcttctgggggtctgcactgcaggaagggggcctgggctggccacagagcagaggatgccagtggggccg

SEQ ID NO: 204203 - DNA, 601 bp, Human
cctaatggatatccaagtctttaatattcaccttgaatcaccttctgggtatatatgtgataggatctctgtcctgcagctcaaattctttctggggaagagacctgtgcatgagaaacagctactactggaatagccactgcttccctccagtcgtgggaaacctcccactgcaggagggaaactcggcggctgagggccgaggggccaggtgggctttgccaggcaaatctccctcggcagctcaggaaggagaccacgctggtgtccaggggtctggcccaccctgagaccactcccytcctggcagtgaccgcatcaggatgccgagatgcctggggctccatcctgcagtcacctgttagaaggacaggactgtgtgaggcctgaggacccaggagagcaggtggaggtcaggaggtgacagtggcaggtgggggccagccctgcagtaagcttcccaggcagtgactgggcatgggctctcctgaagggggtgcctgcctggagatggccccttctggctggccgcctggagggagggtcctccaaggaagcccacacagccaagctggaggggccacctggaaatgcctccgtg

SEQ ID NO: 204204 - DNA, 601 bp, Human
tatcttacagtcccaccagcagtgtagacggcttccaggggctccatgtcctcaccaacacgtgttgttttctgtttttgttttttaaaatcatcatcatcctaatggatatccaagtctttaatattcaccttgaatcaccttctgggtatatatgtgataggatctctgtcctgcagctcaaattctttctggggaagagacctgtgcatgagaaacagctactactggaatagccactgcttccctccagtcgtgggaaacctcccactgcaggagggaaactcggcggctgagggcmgaggggccaggtgggctttgccaggcaaatctccctcggcagctcaggaaggagaccacgctggtgtccaggggtctggcccaccctgagaccactcccctcctggcagtgaccgcatcaggatgccgagatgcctggggctccatcctgcagtcacctgttagaaggacaggactgtgtgaggcctgaggacccaggagagcaggtggaggtcaggaggtgacagtggcaggtgggggccagccctgcagtaagcttcccaggcagtgactgggcatgggctctcctgaagggggtgcc

SEQ ID NO: 204205 - DNA, 601 bp, Human
tatcggtggacgctcggctcgcctccaccttttgctatttgagtaatgctgctatgaacatgggtggagaaatatctctttgagactctgctttcaattctcttgggtattttcccagaagtggaattcctggaacatacggttctatgtagaattttaattgattttagagacaagatattgctctgtcactcaggctggcgtggagtggtgtgatcgtagctcactgcagcctggaactcctgggctcaagcgatcctcctgcctcagcctcctgagtagctgggactacaggtgcctrggcccgcccaggcgggtcttgaactcctggcttcaagcagtcctcctgcttcactctccctaacaactgtataatttttcaaggacccatgacactgttccccacagaagctgcactatcttacagtcccaccagcagtgtagacggcttccaggggctccatgtcctcaccaacacgtgttgttttctgtttttgttttttaaaatcatcatcatcctaatggatatccaagtctttaatattcaccttgaatcaccttctgggtatatatgtgataggatctctgtcctgcagctcaa

SEQ ID NO: 204206 - DNA, 601 bp, Human
aggagaatcgcttgaacccaggaggtaaaggttgcagtgagccaagatcgcgccactgtactccagcctaggtgacaagggagaaactctgtttcaaaaacataaaaaccaaaaaacccacaaatttggccaggtgtggtggctcacacctataatcccagcactttgggaggccgaggtggaaggagagcctgaacccgagttcgaggctagcctgggcaacacagtgacaccctgtctctacaaaaaataaagaatgtgccattgtgaccatgttgaagtacacaattcagtggcattatgtattcccgatgctgtgcgtccacctccagatgaacgcaaaatggaacctctgtccccactagacgccaactccccattcctctcccccagtccctaacaatccccattctcctgtctgtttcttgaatctgactacttgaggtgcctcatgcaagtggaattgtacagtacaaaatgtgtcctttgtgaccggctcaattcacggagcataaggacctcagggttcatccctgttgtagcatgtaacagaattcccttcctctttaaggctggataatactccacggtacacacacac

SEQ ID NO: 204207 - DNA, 601 bp, Human
aaactgtggatgatctaggatttttaaattgttaaacatacatttaaaaacacaaattttggctgggcgcagcgcctcactcctgtaatcccagcactttgggaggctgaggtgggcggatcacctgaggtcaggagttcgagaccagcctggccaacatggtgaaaccccgtctctactaaaaatagaaaaaattagctgggtgtgttggcaggtgcctgtaatcccagctacttgggaggctgaggcaggagaatcgcttgaacccaggaggtaaaggttgcagtgagccaagatcgcrccactgtactccagcctaggtgacaagggagaaactctgtttcaaaaacataaaaaccaaaaaacccacaaatttggccaggtgtggtggctcacacctataatcccagcactttgggaggccgaggtggaaggagagcctgaacccgagttcgaggctagcctgggcaacacagtgacaccctgtctctacaaaaaataaagaatgtgccattgtgaccatgttgaagtacacaattcagtggcattgtgtattcccgatgctgtgcgtccacctccagatgaacgcaaaatggaacct

SEQ ID NO: 204208 - DNA, 601 bp, Human
acctgtgcccacgtggcttacaccttccactcgggagccggtgggacttgcctggggcccgagcacttggaggggccacctccagggatggctccggtaaccctccgtctccctgcaaggctgtcaccagccttctgatgcccagccctctccagcacagcctggcagccaccctcgaagcccacctcacagcagccagacccctcaggctccaggcgagcactccaggccatgcggcctcactggggagtctgggcccacttgggcagggggaggagtgcggagagggccctggggcacygcttcatgccaggtgggacttgggagctcctggcctcagaatattcggggccccaccactagctccttcagacagggtgcggccatgtgggaagacctcgccacagcagccccatggctccggacctgtggttccgagcgtgcattgcaggaggtgaaaagcataccccacctccacccaccagatgccagaagcacccccacccagtgtcccaggcactgtcaaacaccccagggggcaagactgctcctgttaaaaaaccaccgctttagaggcaggtagggaattggtcaatccaag

SEQ ID NO: 204209 - DNA, 601 bp, Human
caggaatgtgctgttttactagttaagagtaataaatcctggttgggtgtggtggctcacgcctgtaatcccagcactttgagaggccaaggcaagaggatcacttgagctcaggagttcgagaccagcctgagcaacatggcaaaatcccatctccacaaaaaacttaaaaattagccgggcatggtggtgcgtgcctgtgttcccagctacatgggaggttgaggtaagaggatcacttgagcctaggaggtcaaggctgccgtgagccatgatcataccactgcactccaggctgggrggcagagggagaccctgtctcaaaaaaaaaaaaaaaaaaattaagagtaacaacacaccctgaacctgtgcccagcacactgaaacccagtgaaaggggctgagagaggatggagagggggagacgaaaaggaccgatacccagaatgggtcaaaacagacgagaaggcatgggaaaggccagcacgctctttataagagtagaactcagccaccccattactgggtatatacccaaaggattataaatcatgctgctataaagacacatgcacacgtatgtttattgcagcactattca

SEQ ID NO: 204210 - DNA, 601 bp, Human
ctatggagaagtatttattacaaaacatgcaatttattcatattggaatttactgaacaagtcactgtttttttaattttggaaatttcaaacatgaaccaaagtgaagggaaacacgacaactccatgtgcccatggcccggcctcagcattcaacaaagacggtcacctgcggtcctcccagccaccaggccctgggtattgaagggttggcactctgcggggcaggggagccccaggttcacacagccacctgcatccctcagaagctccacttctctctctggtgtgttcctagacrtctcagctttcacttccttgtccttcaggacatgtccacctgggtgacaaccccatccaatgagagtggatgaagtaccatgtcagaggtgcctctcttttcttgcagatcagactgcacaaatgtccagtgtctgaaccgcatggaagggcaggacaggactgcatctcccaacgagccgagccgcccacaggacacagacacagacacggcctccacagccacaccaggtcccacctcagcccagcacaggcctttcccacagtcagtgaccccaaggaaagacgtcggatcagggaa

SEQ ID NO: 204211 - DNA, 601 bp, Human
gctaagagcacgtcggagaaagaataagaacgcgatagagaaaagcacagctactgctttcagaaccagtttgagggaatcatcctcatagtgtgtgggtgtctgtactgaggtgtttaaggcatttttggatcagatatgttaagcttgtagtttccattaaatatttagaagtgtttataatgagtttacagtcaatgtttaaatgtcaggagaaatttactttgttttatccaacaagttttgatttatcaactgggagtgtgactctatggagaagtatttattacaaaacatgcamtttattcatattggaatttactgaacaagtcactgtttttttaattttggaaatttcaaacatgaaccaaagtgaagggaaacacgacaactccatgtgcccatggcccggcctcagcattcaacaaagacggtcacctgcggtcctcccagccaccaggccctgggtattgaagggttggcactctgcggggcaggggagccccaggttcacacagccacctgcatccctcagaagctccacttctctctctggtgtgttcctagacgtctcagctttcacttccttgtccttcaggac

SEQ ID NO: 204212 - DNA, 601 bp, Human
cgacggagcgagactccatctcaaaaaaaaaaaacaaaaaaaaaaacagaaaacaagtgtgtggagaaatctgaacccttgtgcgctattggtgggaatgtaaaaatggagtagcagctatggaaaacagtgtggtcatttctcaaaatcctggacatagaattaccatatgagccagcagttcctcttgtggcagaatacccaagagaactgaaagcagggctgcaaagatatttctatacccacgttcatagcggcattactcacagcagccaacaggtgggagcaacccaagtgtccrttgacagaagaatgaatcaacaaaacgtggtacagacatacaacagaatagtgttcagccttataaaggcagggagttccgacacaggctagaacacggatgaaccttgaggtccttacactcagtgaactaagccagccacaaaaagacaaatgctgtgtgattccacttacatgaggcgcctagagtagtcagattcacagagacagagagtagaatgctggctgccaggggaggggaatgaggagttcttgtttaatggggacagagtttcagttttctgagatgaagagttctgag

SEQ ID NO: 204213 - DNA, 601 bp, Human
aaaacagggccgggtgcagtggctcacgcctgtaatcccagcactttgggaggctgaggcgggtggatcacgaggtcaggagatcgagaccatcctggctaacatggtaaaaccccgtctctactaaaactacaaaaaattagctgggcgtggtggcgggcacctgtagtcctagctactcgggaggctgaggcaggagaatggcatgaacccaggaggcagagcttgcagtgagccgagatcgcgccactgcactccagcctgggcgacggagcgagactccatctcaaaaaaaaaaaamaaaaaaaaaaacagaaaacaagtgtgtggagaaatctgaacccttgtgcgctattggtgggaatgtaaaaatggagtagcagctatggaaaacagtgtggtcatttctcaaaatcctggacatagaattaccatatgagccagcagttcctcttgtggcagaatacccaagagaactgaaagcagggctgcaaagatatttctatacccacgttcatagcggcattactcacagcagccaacaggtgggagcaacccaagtgtccattgacagaagaatgaatcaacaaaacgtggtaca

SEQ ID NO: 204214 - DNA, 601 bp, Human
cattgttaagatatccatactacccaaagcagtctacagattcaatgcattcccttcaaaaatcccaatgacattttttgtagaaatagaaaaagccattttgaaattcatatggagtctcaaggaccccttaatagctaaaacaatcttaaaatgaataaacttggaggattcatacttcctggtttcaaaatttactataaagctatagtaatcaaaacagtgtggtactggcataaaggcagatgtaaagaccaatgtaatagaatagacagcctagaaataaccatcatgtatatatcagtgatatttttctcaattagaaacagggtctcactgcgttgcccagtctggtcttgaactcctggcctcaagcaattctcctacctctgcctcccaagtagctgggactataggtacatgccactgcacctggctggccaaatgatttttaatgtggtgaccattcaatgggggaaaagactgtctttttaacaaatgatgttgggaaaactggatttacaaatgcaaaagaatgcagtttgatcccccacctcataccctataaactcaaaatagagcaaagacctaaattaagacc

SEQ ID NO: 204215 - DNA, 601 bp, Human
acataacaagaggttttgttatcaaaagagactcagcattaaaaataataaaatacttaagaattagcttaactagggaggtgaaagacttgtacactgaaatctataaaacactgctgaaagaaattaaaacataaataaatggaaatacatcccatgttcatggattggaaaacttaacattgttaagatatccatactacccaaagcagtctacagattcaatgcattcccttcaaaaatcccaatgacattttttgtagaaatagaaaaagccattttgaaattcatatggagtctsaaggaccccttaatagctaaaacaatcttaaaatgaataaacttggaggattcatacttcctggtttcaaaatttactataaagctatagtaatcaaaacagtgtggtactggcataaaggcagatgtaaagaccaatgtaatagaatagacagcctagaaataaccatcatgtatataccagtgatatttttctcaattagaaacagggtctcactgcgttgcccagtctggtcttgaactcctggcctcaagcaattctcctacctctgcctcccaagtagctgggactataggtaca

SEQ ID NO: 204216 - DNA, 601 bp, Human
tccaactaataggctcaagtgatcctcctgcctcagcctcccgagtaactcatggcctttaagtgaactgcttccaccatccagctgtgcaggtggcctgggaacagcagcacatctgtcccctgccacctcttgcatgcacacttgacctcctgacttgggctctgaaacctgtaaaatgtggggtgtagagaaatcgagtcatttggcctcatcctggtgccattatctcttgctacattaataaaccacctcaaacagagcagcataacagccattctgggcacgtgggctccgtggrtcgggaatttaggagaggctgggctgagcagtttgtctactccacggggtgatggccagggctggaggattcgcttccatcacagcctcttcactcaggtgcttggagccttggcttcattcaggggctgggcacagcggggaccaccaacctgagtaccttcaagtgtccttgcagtgtggtggtctcagggactcagacttcttacttgggggcttcaagagcacgtccagcaagccaggttggagcccagagccttctgtgaccagccctggagtccaggagaggggaaacagatcc

SEQ ID NO: 204217 - DNA, 601 bp, Human; identical to SEQ ID NO: 26966

SEQ ID NO: 204218 - DNA, 601 bp, Human; identical to SEQ ID NO: 28513

SEQ ID NO: 204219 - DNA, 601 bp, Human; identical to SEQ ID NO: 28514

SEQ ID NO: 204220 - DNA, 601 bp, Human
cctactaaggaggctgaggcaggaagggtcagttgaacccaggagtttgaggctgcagtgagccatgattgtgccagtgtactccagactctccttaaaaaaaaaaaaaaaagatgacaaagaccaagttcttgtgttcaggctgttcccagtcccacagggtagtcagacacacaccttaccaagaacaccaggtgagacattgtacatggcataaaaagtacagacagtttgagggcatagcacaaaaagtacctgggtatcgttgtatacattgacgacattgactggcctatgggtrtcacacacaaagaatatagtgtcttcatcaggttgaagaatatccaataggtctacattagctccacagtttatgagaataaaataatgaaactgaaaaaaaggaagatattgtaaagtagctatatcgaggaggccccttttccttcatcactaagcctctgagttgttctgcttaaactcactcagtccctgacatgtggcgaggcccacgtggcaagggactccaaaaaatggccaggctggcatgctaagtgctttagcatggtgacacagcagggtgggccctggggctcccagt

SEQ ID NO: 204221 - DNA, 601 bp, Human
gcagacccacattgctcctctgcagtgactgcatagtaagtgatgctagaagacagtagaaaaggaaggggtgggggttacactatttattgcttctctacattatttttttgctatctagccgcagagctgagctgtcctaaatttcatttcttctgacaggatcctattggacagataagccactatttagggaagtccagtaacctgcctgaggccacataaccaggggacagcagagcccagggtcagcatccatgcctgctaacttttccacttcccactgccctcagtacacctyggcctggcaggcttcaggatgacctccgacctctgggagtgcaagttcctctgggatagctgtgagagacccaaactcacctcttctaaccgtgtgcgcttctcagaaggctctgacccatcactgtcatttcctgaatgctcttcatcctcctcttcatccctgaagatgtcttcataggcgggaacttcaaggtcatcatcttgtttaatgagtaatttgatctaagttcaaaacaaaaaggaattaagcctctcctctttctacggaaaactatacaatatgttcttctgcagaatc

SEQ ID NO: 204222 - DNA, 601 bp, Human
ggcatgtgcttagtctcagctacttgggaggctgaagtgggaagatcgagtgagcccgaagtttgaggccagcctgggaaacagagagagaccccgtctggggaaaaaacaaaaaaaaaaacaaaaaacaaaaagtcttccaaaaaatagaacaaagagctgggcaagaggtaagaaaatataacagtgggtccaagaggttccctatgagacacccaaacctagtgaaaggggtgacaaaggtgagaaagaagagagaagcatgcctcagtttgaagggcattgccccttccccaaatgragaatgtcttgaacatctcaaatatggctcaaaaaggcttcccaaaagcacattaccgggaaatgtcaggctgaggatgaagggaagaccctagaacattacgggggcaaattctaggtcacacaccaagatcaggagccagaggccatcttcaaaagcatcacgtggccctccgtgctatgggaacaaccaccttctgcctgtcattttacatcttgcagaagccgtagtgttgggtaggccactgggcccagccccagatcactaagcagctcagacccaaggtccacatggtgaaaa

SEQ ID NO: 204223 - DNA, 601 bp, Human
aagacttatctgtagaacatgaatgtttcccgggaaatcccattggatactgacatttgggaaccaatgaaatgcagctcatcgatagttaaaagaatgctatataaaaaaaaattcagagaacaaaaaggacccctcacaaaccaaagattagaagataaagaccaagctgagtgtagtggcatgtgcttagtctcagctacttgggaggctgaagtgggaagatcgagtgagcccgaagtttgaggccagcctgggaaacagagagagaccccgtctggggaaaaaacaaaaaaaaaaacaaaaaacaaaaagtcttccaaaaaatagaacaaagagctgggcaagaggtaagaaaatataacagtgggtccaagaggttccctatgagacacccaaacctagtgaaaggggtgacaaaggtgagaaagaagagagaagcatgcctcagtttgaagggcattgccccttccccaaatggagaatgtcttgaacatctcaaatatggctcaaaaaggcttcccaaaagcacattaccgggaaatgtcaggctgaggatgaagggaagaccctagaacattacgggggcaaattctaggtc

SEQ ID NO: 204224 - DNA, 601 bp, Human
gaatatcatggtttctggctggctgtggcagtgcatgcctgtaatcctagctacttgggaggctgaggcaggcgaatcgcttgaacccagaagacagaggttgaagggagccgagatcgtgccactgcaccccagcctcagtgacagagtgagactccatctcaagaaaaaacaaaataaaaaataaaaaagaatatcagtttctgcaatctattctcaaataatacagaaaaaagaatacacagaaagaaagcaaatgtggcaaatgtgaaaaactgtttttgttttttttgagacaggktctcttcatgttgcccaggctgttctcaaattcctgggcttcatcaatcctcctgccttggcctcccaagtagctgagaccacctacagtcatgatccactgttgactctagattgaaggtacatggatattcactgtactatcctttcaaccactgtatacatttcaaaaaatttcaaaataaaaagttggtgggaaattatgcctattataatccatgaatattatgttaaacatttacaaacacaaattccaaattgatgtgttaagtatgtaaaaggaaacgctgattattttcct

SEQ ID NO: 204225 - DNA, 601 bp, Human
gtaatttgttaaacatcagtaggaaccaaaacaattaagtctagttattctccttattttacaatggcacacagaggttaagtcacttgcctacagtcacaaagctgttatagcagatacaaaatttgaaacccgtgacctgagccacgatattatagcacctgtagattaagtataattatggttatttttatagcggactctcatctttgctggggtccagctctaacatccaacctttaaaagacaagtaaaaatgattctcgaccccatgtctcctcttttctttacagcagaacttttttttttttttttttttttttgagacggagtcttgctctgttgcccaggctggagtgcagtggtggatctcagctcactgcaggctctgcttcctggattcacaccatcctcctgcctcagccttctgagtagctgggactacaggctcctgccaccatgcccgggaaattttttgtatttttagtagagatggggtttcaccgtgttagcaggatggtctcaatctcctgacctcgtgatccacccacctcggcctcccaaagtgctgggattacaggcgtgagccaccacgcccggc

SEQ ID NO: 204226 - DNA, 601 bp, Human
ctatattacttcttacaactacatgtgaatctgtaattatctcaaaagaaaaactttaattaaaaaaaagccatggtcctggtgaggaaactttttgcgggtaatggaattgttctctatcatggtgggatggtggttgcatctttatacatttgttaaatctcattgaattgtaccacctagtgaattgtgtagacattatgcctcaataaagtaacaaaattcccacagcctgagatttctttgaccctgccacaatgcatggtggggtcctgtcccctcccttgtggctactggatgmtgaggtactccaaggctggtcgggagagccatgcagtggctgcccgggtgactggaatattcatgctggaagcctgagcagtcatgttgtaaggaagtcacattcaatggagagaccctgcaggtgcttggctcagtagtcctggtttggagccctcccagcagatgtctgagccatgcttccagttcttagccattgagtccccacctgagggcccagatatcacagatcaaaaagatgtcatcctcactgggctctgcccaaattcctaacctacagaatccatgagcataaggaaaa

SEQ ID NO: 204227 - DNA, 601 bp, Human
tccagtagctctcccccaaaggaacggttaaaggagactcttaaatagaaaggaaatggaaaagaaaccttagaatactggaaaggaagaaaaaaatacagtaagcaaaaatgaggtaaatacaataggctttccttacttatcctcttgagtttgtaattatgcttaattactgaagcaaaaattataacactgtatatgtggaggaaatatttaagaaaattatattataaatggggcagagtaaaagacattaagagaagacaaggccaggcacagtggctcatgcttgtaattccascactttgggaggctgaggcaggtggatcacttgaggtcaggagtttgagacgaacctggccaacagagtgaaaaccatctctactaaaaatacaaaaattagccgggcatggtggcacacacctggggtcccagctactcgggaggctgaggcaggagtactgcttgaacccgagaggtagaggttgtagtaagctgagattgtgccactgcacaccagcctaggtgacagagtgagactccacctcaaaaaaaaaaaaaaaagaagataaggtttctacatgtgactcaactggtaaaa

SEQ ID NO: 204228 - DNA, 601 bp, Human
agtattttccaaatgctgaaagaaaataagtattaacccagaattctacatccagtaaaagtaccttttaggaataaaaaaaaaaaaatcaagaaattctcaaagatggaaaactaagggaatttatctccagtagctctcccccaaaggaacggttaaaggagactcttaaatagaaaggaaatggaaaagaaaccttagaatactggaaaggaagaaaaaaatacagtaagcaaaaatgaggtaaatacaataggctttccttacttatcctcttgagtttgtaattatgcttaattastgaagcaaaaattataacactgtatatgtggaggaaatatttaagaaaattatattataaatggggcagagtaaaagacattaagagaagacaaggccaggcacagtggctcatgcttgtaattccagcactttgggaggctgaggcaggtggatcacttgaggtcaggagtttgagacgaacctggccaacagagtgaaaaccatctctactaaaaatacaaaaattagccgggcatggtggcacacacctggggtcccagctactcgggaggctgaggcaggagtactgcttgaaccc

SEQ ID NO: 204229 - DNA, 601 bp, Human
gtcctccagcctgggagacagagtgagactctgcctcaaaaaaaaaaaagacataaacctgcagattcaagaagctgggtaacgggaggtggaggttacagtgagctgagatcgtgccactgcattccagcctgggtgacagggcaagactctgtctcaaaaaaataagagaaacaaataggatagacacaaatccacaccaagacacatcctaacatcctaattaaacttctgaacactcaaacaaaaccaaaatatctcaaaaacagccaaagaaaaataagactttcatgatagggawaaagcctgaatgacagaggatttctcatgagaaatcacggcagccagagtaagtggcacagtattttccaaatgctgaaagaaaataagtattaacccagaattctacatccagtaaaagtaccttttaggaataaaaaaaaaaaaatcaagaaattctcaaagatggaaaactaagggaatttatctccagtagctctcccccaaaggaacggttaaaggagactcttaaatagaaaggaaatggaaaagaaaccttagaatactggaaaggaagaaaaaaatacagtaagcaaaaatg

SEQ ID NO: 204230 - DNA, 601 bp, Human
ttaactcagcaaataggctcgagagcagaatgaaggggacagagggaagaattagtgaactggcagaaagacagaaattacccagtctgaacaaccgagaaaaaatagaccaaaaaaactagaacctctgggacttgtggggctacaacaaaagagctaacattcacgtcatcagtgccctggaggaggagaaagagggtgcactgaaaacacacttgaagacataatggctgaaaatttggcaaaagacataaacctgctggctgggtgtggtggttcacacctataatcccaacacttygggaggccgaggcgggcagattgcttgaggccaggagtttgagaccagcctggccaacatggaaaaacctcatctctactaaaaatacaaaaaaagtagccaggcatggtggcacatgtctataatcccaactactcaggaggctgaggcagaattgcttgaacccaggaggcagaggttgcaggtcctccagcctgggagacagagtgagactctgcctcaaaaaaaaaaaagacataaacctgcagattcaagaagctgggtaacgggaggtggaggttacagtgagctgagatcgtg

SEQ ID NO: 204231 - DNA, 601 bp, Human
actggaatattaactcagcaaataggctcgagagcagaatgaaggggacagagggaagaattagtgaactggcagaaagacagaaattacccagtctgaacaaccgagaaaaaatagaccaaaaaaactagaacctctgggacttgtggggctacaacaaaagagctaacattcacgtcatcagtgccctggaggaggagaaagagggtgcactgaaaacacacttgaagacataatggctgaaaatttggcaaaagacataaacctgctggctgggtgtggtggttcacacctataatcmcaacactttgggaggccgaggcgggcagattgcttgaggccaggagtttgagaccagcctggccaacatggaaaaacctcatctctactaaaaatacaaaaaaagtagccaggcatggtggcacatgtctataatcccaactactcaggaggctgaggcagaattgcttgaacccaggaggcagaggttgcaggtcctccagcctgggagacagagtgagactctgcctcaaaaaaaaaaaagacataaacctgcagattcaagaagctgggtaacgggaggtggaggttacagtgagct

SEQ ID NO: 204232 - DNA, 601 bp, Human
tgggcgcagtggctcacgcctgtaatcccagcactttggagacaggcgggcggatcacatgaggtcaggagttaaagaccagcctggccaacatggtaaaaccccgtctctacttaaaatacaaaaattagccgggcgtggtggcacatgcctgtaatcccagctacttgggaggctgaggaggaaaactgcctgaacccaggaggtggaggtagcagtgagccgagattgtgccactgcattccagcctgggtaacagagcaagactctgcctcagaaacatacaaacaacaacaacaamaaaaaaaaaacaaagtaagactctgaaaggtagaggtgaaggcagagcagttagggactctgggacatgaggaacaacacagtgttccttgagttttccttctggttcatatatgccagagttggagctgaaaagccagcaacctagaaataccaacaggtgcagacaacaaaacaaaacaaaacaaaacaaaacaacaaaaaaaaaaacccacaaaagctgctctgtctagtcaaaggactgggaaggagcaacctcccaagacagaaagcttttaggcagtagcccatctactctagc

SEQ ID NO: 204233 - DNA, 601 bp, Human
aagtgagcatcagcaccctccccaccaactgtttagaattttccattagcaaggactgagcagagacagcaaaaggatgatccttcaaaggacaatggaaccttgacaataaaagggacactggaaatacggtgcttagagttcaaggtcccagtattaaattctaagactaaatacaggatgttttattgaaacttattttctagggctccttaaggccttgagctctgctcaacactattgacatagtaggttttctacactaaattctgttttgtaaaagacacacactgatgggccrttataagtctatagcgttttatcttctcgcacagagactggtacaaactcattctgtgtttttgatgaacaaaaataaacgctgctcttctttgatcacctattgggtgcaaacgaccattttaataattacctctgaaatgaggattattctctttacagaggaggagatgtttaaggctcagagagcttgcaacacctgcccaaggtcacacagggggaagacatggagctcagattcaaaccaggcttttgtggctctaaaatctacgtttcttcttcacatttgaggacactgacc

SEQ ID NO: 204234 - DNA, 601 bp, Human
ggaaggccaggtgaggcagagccctgggtccaattatttgaatattaaagagggaggggcctcagcacctctctttccaacagggctgtccacatcggagcatttaactcccataagcagagggtctctatttggtaaaagaccttgaggaagactggtgtctgaccagaagaccctaagatcccctttgccgtgagatgcgggcttcctccagggagagaatttccaagggaactggccccatatatctggagggagttatcttctctaagtgagcatcagcaccctccccaccaactgyttagaattttccattagcaaggactgagcagagacagcaaaaggatgatccttcaaaggacaatggaaccttgacaataaaagggacactggaaatacggtgcttagagttcaaggtcccagtattaaattctaagactaaatacaggatgttttattgaaacttattttctagggctccttaaggccttgagctctgctcaacactattgacatagtaggttttctacactaaattctgttttgtaaaagacacacactgatgggccattataagtctatagcgttttatcttctcgca

SEQ ID NO: 204235 - DNA, 601 bp, Human
ctcagtcacccaggctggagtacgatggcacaattgtagctcattgcagccctgaacttctgggctcaggaaatcttcctacctcagcctcctgagtagcttggactacaggtacacactatgacacctggctaatttttgagacagagtttcattcttgtcgcccaggctggagtgtaatggcgcagtctcggctcactacaacctctgccttccggattcaagcgattctcctacctcagcctcctgagtagctaagattacaggcacccaccaccacgcctggctaatttttttttttctatttttggtagagacagggttttaccatgttggccaggctggtctcgaattcctgaccttccaaagtgctgggattacaggggtgagccaccatgcccagacaatttttttttttgagacagggtttcacttcattgcccaggctagtctcaaactcctgcactcaagtgatgctcctgtctcggcctcccaaagtactgggattacggatgtagaattaaggatgtgagccactgcaaaggctgcctccttcaaatctcacactcctcctgtcacttgactttactgagtacaggct

SEQ ID NO: 204236 - DNA, 601 bp, Human
gcagggctggggaggcaggaaatagtggcatggggcctattcaaactgcatgaggagaccagcacccaattggaggctgcgcctagggctgtgccaggtgacagcctggggacatctacatgggtcccctaggagaggaccagcatgttggggtctaggtccatgccaatccctaagagattctgcctgatggccactagagaaggttgggccacttcgtgcattagcagggatgaaagaagaagccaacccccacttcgccctgcagcatctgcattctgaggcagccttgcagctcacygtcagtctatcagatggggagcccaccactgagggcaaaaggggttctgcttcacaccagaccccttacctttggagccttccccttacctttggggtcaaacccctactgcttggcaagatactcagggtcctcactaggggctctcatcccgcccccaacctgctcctgtgttgtcttcccccatccccccacctactgcaagggccacacctcagcacctgcctctaagcctggccctgctggtagcacccagcacaagcagggcactgggagagaactggggaggctggctctacc

SEQ ID NO: 204237 - DNA, 601 bp, Human
gggcagtgggctgtgccaaggtgacctgtccaggccgtagctccaggcctgaaacttgggcttctcctgccttgtgggccttattgcaggatccagacaggggcagggctggggaggcaggaaatagtggcatggggcctattcaaactgcatgaggagaccagcacccaattggaggctgcgcctagggctgtgccaggtgacagcctggggacatctacatgggtcccctaggagaggaccagcatgttggggtctaggtccatgccaatccctaagagattctgcctgatggccactagagaaggttgggccacttcgtgcattagcagggatgaaagaagaagccaacccccacttcgccctgcagcatctgcattctgaggcagccttgcagctcaccgtcagtctatcagatggggagcccaccactgagggcaaaaggggttctgcttcacaccagaccccttacctttggagccttccccttacctttggggtcaaacccctactgcttggcaagatactcagggtcctcactaggggctctcatcccgcccccaacctgctcctgtgttgtcttcccccatccccccaccta

SEQ ID NO: 204238 - DNA, 601 bp, Human
tttctagcccctacattatctgtgcacaaattccatgctactcttaacacacgaagggactcagggcccaacagggcagtgggctgtgccaaggtgacctgtccaggccgtagctccaggcctgaaacttgggcttctcctgccttgtgggccttattgcaggatccagacaggggcagggctggggaggcaggaaatagtggcatggggcctattcaaactgcatgaggagaccagcacccaattggaggctgcgcctagggctgtgccaggtgacagcctggggacatctacatgggtyccctaggagaggaccagcatgttggggtctaggtccatgccaatccctaagagattctgcctgatggccactagagaaggttgggccacttcgtgcattagcagggatgaaagaagaagccaacccccacttcgccctgcagcatctgcattctgaggcagccttgcagctcaccgtcagtctatcagatggggagcccaccactgagggcaaaaggggttctgcttcacaccagaccccttacctttggagccttccccttacctttggggtcaaacccctactgcttggcaagatact

SEQ ID NO: 204239 - DNA, 601 bp, Human
ctggtctcgaactcctgacctcaggtgatccactcacctctgcctcccaaagtgctgggattacaggggtgagccatcgcgcccggcctccaaaatgtgttataggaccaggcggtccatatgtccactgtgcagtaacagacctgttacactgagacagcagagtttgcagcagaggaagagtttcatgattgcagggcaccaagtaaggagatgggaggagatcttcaatccatctccttgaggagttttgggctggggcttttagggagactgtggagggctggaaaattgggatagytgattggtggggcaagggggatgtaatcatcagggtgtacaaactgcactcttggtttagtcagctcctcgtggggtccttcggagcagctcagtcagtagctccatcagtatgtgggacccaaagaaatatctcaaagggaaaacggcatttcctaaggttcaagttgtgatctatggagcagttaggggaactacaatcttgtgacagggtctacatgtttcggaggcaatgagacaccaagcagctacgaggaagcaggcagagagcacgccgacctagtgactgatgctgatgtgc

SEQ ID NO: 204240 - DNA, 601 bp, Human
tcgccacgtcaaatctgggcgcagagtggaatgatcagtgtctgcatttttgttgtgtgtatatcgtctcagctggaatgagaaatattgatttggttactccaagctgggcactgggctgcatcttgtgaaactgggaagacaagagacgtacatcttcatcaggatagtgcagtgggtaacctacccactaaaagaagaaattcctgtggaaaaactatgagaaagtttctgcctgctttctttttttaaaacagggtctcactctgttgcccaggctggaggacagtggtacaatcayagctcactgaagctttgacctcccgggttcaagtaatcttcccacttcagcctcccaagtagctgggaccacaggcatgcaccaccatgcccagctgattttttttttatttttatagagaggggttctatgttacctaggttggattcctgcaatcctcccacccccgacaaagtgctgggattacaggcatgagccatcacccctgtctcttttctgtctgctttgaatctggtattattaagctactggtattgagaaaagactcactgtctatggtattattcagagctacttgga

SEQ ID NO: 204241 - DNA, 601 bp, Human
tcctgtatactgatggagctactgactgagctgctccgaaggaccccacgaggagctgactaaaccaagagtgcagtttgtacaccctgatgattacatcccccttgccccaccaatcaactctcccaattttccagcccctcaccctccagtccccttaaaagccccagcccaggccgggcacagtggctcatgcctgtaatcccagcactttgggaggccaaggtgggcagatcacctgagggcaggaatttgagaccagcctgaccaacatgaagaaaccccgtctctattacaaatwcaaaattagccgggcgtgttgctgcatactggtaatcccagctacttgggagggtgaggcaggagaatcacttgaatctgggaggcggaggttgcgatgagccgagacagcgccattgcactgcagcctgggcaacaagagcaaaactccatctcaaaaacaaacaaacaaacaaaaccaaaaaagcccagcccagaactcctcaaggagatggatttgaggatctcctcccatcttctcactcggtgccctgcaatcatgaaactcttcctctgctgcaaactctgctgtctcagtgta

SEQ ID NO: 204242 - DNA, 601 bp, Human
catcagcatcagtcactaggtcggcgtgctctctgactgcttcctcgtagctgcttggtgtctcattgcctcagaagcatgtagaccctgtcacaagattgtagttcccctaactgctccgtagatcacaacttgaaccttaggaaatgctgttttccctttgagatattcctttgggtcctgtatactgatggagctactgactgagctgctccgaaggaccccacgaggagctgactaaaccaagagtgcagtttgtacaccctgatgattacatcccccttgccccaccaatcaactmtcccaattttccagcccctcaccctccagtccccttaaaagccccagcccaggccgggcacagtggctcatgcctgtaatcccagcactttgggaggccaaggtgggcagatcacctgagggcaggaatttgagaccagcctgaccaacatgaagaaaccccgtctctattacaaatacaaaattagccgggcgtgttgctgcatactggtaatcccagctacttgggagggtgaggcaggagaatcacttgaatctgggaggcggaggttgcgatgagccgagacagcgccattgcact

SEQ ID NO: 204243 - DNA, 601 bp, Human
cggtggttgtggcgggaaacgtggcgctgcaggacaccaacatcagtcacgtatttcattctggaaaaaaaagtagcacaagcctcggctggttccctccagctcttaccaggcagcctaagcctaggctccattcccgctcaaggccttcctcaggggcctgctcaccacaggagctgttcccatgcagggactaaggacatgcagcctgcatagaaaccaagcacccaggaaaacatgattggatggagcgggggggtgtggtctctagccttgtccacctccggtcctcatgggtctyacacctcctgagaatgggcaccgcagaggccacagcccatacagccaagatgacagactccgtaagtgacagggatccacagcagagtgggtgaaatgttccctataaactttacaaaattaatgagggcagggggaggggagaaatgaaaatgaacccagctcgcagcacatcagcatcagtcactaggtcggcgtgctctctgactgcttcctcgtagctgcttggtgtctcattgcctcagaagcatgtagaccctgtcacaagattgtagttcccctaactgctccgtagatcaca

SEQ ID NO: 204244 - DNA, 601 bp, Human
gagatccgtgtgcagtccacggagagtgtgttctcctcatcctcgttccggtggttgtggcgggaaacgtggcgctgcaggacaccaacatcagtcacgtatttcattctggaaaaaaaagtagcacaagcctcggctggttccctccagctcttaccaggcagcctaagcctaggctccattcccgctcaaggccttcctcaggggcctgctcaccacaggagctgttcccatgcagggactaaggacatgcagcctgcatagaaaccaagcacccaggaaaacatgattggatggagcsggggggtgtggtctctagccttgtccacctccggtcctcatgggtctcacacctcctgagaatgggcaccgcagaggccacagcccatacagccaagatgacagactccgtaagtgacagggatccacagcagagtgggtgaaatgttccctataaactttacaaaattaatgagggcagggggaggggagaaatgaaaatgaacccagctcgcagcacatcagcatcagtcactaggtcggcgtgctctctgactgcttcctcgtagctgcttggtgtctcattgcctcagaagcatgt

SEQ ID NO: 204245 - DNA, 601 bp, Human
atctccttgcccccaacctacctctactgggcagccaagggaccttttaaaaaccctgactcaaactctggtcactccacagcctcccgctgcccttggctcacaaggcttgctctggcctcctgacacctgaccccagccagtcccccagcccctcctgtgctcagtacagcagctgccacactgagtgtggctgagactgtgtgagatgtggtctccccatggtcttttctgagcactccaccaatgtcccatgtgcttctcaaaagacacgtcacgctgtgtgattacatggcagctsccttctttcctgactgcgtgaaccactgcccgcactgctaccatgtccagagccaggcccacaataagcactttacagggatgtgctggagaagggtgatacttccaaactcagctctggcatttagaagccaaagccacacagatgagctggggtagcacaccacagccccttcccccaaaacttcctgccccacctgctttccctcctggggatgtggccagaacccacagagggtgacaaagcaaacaaggcctgctgagcaggggtgctgcctgtgcccctcaggctgggccacaa

SEQ ID NO: 204246 - DNA, 601 bp, Human
acaggcatagaccaccatccgtctgacaggcagagaatctggagcacaggggtctgcaaagtccaggtgctgtggtcacatggagcagtcatggccacacatgacgtaggaggctgggcgtcaccagcttgtcgtcctgcacctcctgctccacctagcccagccctccctacaacccattcctccggagagccctccactgggaccccatccacgaagcgcccccatcctcagcccttttttcgttttttttttttgagacggagtctcgctctgtcgcccaggctggagtgcagtggcrcgatctcggctcgctgcaagctccaccttctggattcacgccattctcctgcctcagcctcccgaatagctgggactataggcacccgccaccatgcctggctgattttttgtatttttcgtagaaacgaggtttcaccgtgttagccaggatggtctcgatctcctgacctcatgatccacttgccttggcctcccagagtgctgggattacaggcgtgagccacagcgcccgacctcctcagcccttttcttaaacatatccatcactgcccctggcaccgtgagcgcagttgtgagt

SEQ ID NO: 204247 - DNA, 601 bp, Human
tcatgggagcaaacacagctgtcaccctcaaattgtgggcaagctctcactgccaggcaggccaacagatgtgctaatgtccctcacaggcccaagtcaatgcttccagcacagccatgctgctcagaggatgaggcaggtcagaacgtccagacataccagccctgcagcccagagtggccgggtgccttcttgtcaacagctttatggctggcttagggggtgtgtggggtcctctctcacaccttagcatgccagctggctggggtgggagaagccaggggcctccaggagtgcccayggacttggtcgggcagagttcacctgaacctggccctgtggcccatttgctgtctccagtgaaacagactggggtcgacctcacaggtcccacagcagccctaggatccaaggatcctaggatcctaaacctcacaagcttgaagaagtcttatttttaacccaaaaagaactcaagacttcaggaatggccagactcagataacactcatttgtacattctcgggttgttgttttttttgcattattttaggagcacgttggttttttttgcattattttaggagcacagttaaagtag

SEQ ID NO: 204248 - DNA, 601 bp, Human
taaattcagtgtatttggagatatttttctctgatgtctttagtctgacactagacagacatgctaaaaaaaagatccaaattgtcacattccatttcaaaacaagcgaaaagacatggaaaaatataggacatctcaggaagtgagataagaaagaattggaaaattaaaaaattgagaaatgacaactataagattaaacacaagaacgaatatacataacaaataatgccttttgttaagagatacaaaaggtaaaaaaagagaaaattttaaaaatcaaaaagaaaaaaaagccaaraaagattcaagagaaagtgacaaatactgaagaggggcaggtaatgtgtcaggtgcacaccacactggcactgtgattccagttcacccaagcagtttctgcaggacacagtcactcccacagccctggggtccccgtaactgacctccctgggcagtgtgagaaccagtggtggccccatgaggcaaacccacagccctcctgctacctggagaggctgtccagagcctggatgaagtgatctgtccctgagccatccttctcggggctctccatcaaagacatggtggcaaagaccac

SEQ ID NO: 204249 - DNA, 601 bp, Human
attagaaaaaaagagaataagggacagaataacacctctctggataatgaaagtacactaatgtgaaagttgcagatcccaggatgaaatcactttttgacaggcccaaacaaattaaagctgggaaagcaccaaggagagctcctgcttgcatgtctggaataaagactcaaagactttctaaataaccccacaagaaatcccttctttaggactgcaacaattcagataagatgctcttaaaatataacacttgcccagtaatgcatcttcaccactgaactgacgccaactctggctytgagtctctgaaaccaatgaattgtttccaagctagctttcgtgaacttctccttttgccaataaaagtgtccccttagcctcctctctttggatgcatatttggcttgccatagctgtgcatcgcagacactataatcctcttttctaattcccaaataaattcagtgtatttggagatatttttctctgatgtctttagtctgacactagacagacatgctaaaaaaaagatccaaattgtcacattccatttcaaaacaagcgaaaagacatggaaaaatataggacatctcaggaa

SEQ ID NO: 204250 - DNA, 601 bp, Human
ggagtcctggtaatgagcaaggggtcctgttaaacagcaagggagcctggtaaagtataagggggcatggtaaagagcaaggggccttgctgaagtgtaaggagactatagtaaagagtaaggggcccagcctgaccaacatgtctctacaaaaaatacaaaaattagccaggtgcagtggcacatgcctgtagtcccagctacctgggaggcagaggttgcagtgagtggaaatcatgccactgcatgccagcttaagtgacagagtaagaccctgtctcaaaaaaaaaaaaaaaaaaaacctccagtgaatcatactcctaatgtaagggctaaaactattaaagtgttagtagaaaaaataatgtgaaatcttcatgaccttgggttaggcaatggtttcttagatatgacaccaaaagcacaagaaacaaaagaaaaagtaggtaacttaaatgtcatcaaaattaacaaatcttatacttcacaggacactgccaaagtgaaaagtcagcctacagaatgggagaaaatacttgcaaattacttatctgataagggatttgtatgtagaatatataaaagttttaggctgggcacg

SEQ ID NO: 204251 - DNA, 601 bp, Human
agtgggccaagggaaagtttaaggagcctccctggagtgcaaggagtcctggtaatgagcaaggggtcctgttaaacagcaagggagcctggtaaagtataagggggcatggtaaagagcaaggggccttgctgaagtgtaaggagactatagtaaagagtaaggggcccagcctgaccaacatgtctctacaaaaaatacaaaaattagccaggtgcagtggcacatgcctgtagtcccagctacctgggaggcagaggttgcagtgagtggaaatcatgccactgcatgccagcttaartgacagagtaagaccctgtctcaaaaaaaaaaaaaaaaaaaacctccagtgaatcatactcctaatgtaagggctaaaactattaaagtgttagtagaaaaaataatgtgaaatcttcatgaccttgggttaggcaatggtttcttagatatgacaccaaaagcacaagaaacaaaagaaaaagtaggtaacttaaatgtcatcaaaattaacaaatcttatacttcacaggacactgccaaagtgaaaagtcagcctacagaatgggagaaaatacttgcaaattacttatctgataag

SEQ ID NO: 204252 - DNA, 601 bp, Human
taaaactatttgtttactttcaacttttaaaatcaacctgtaaccaaagataagacaatttatatctttttctctaacccaagattgttatcagtcttgaaaacgtaaaagcacaaatttcagaaagtactgagcagcactgaagagcaaagtaaggctgtttctacaccttggacatttgtcccctcaaaacctcatgttgaaatctgatccaagatcttcgaggtggggtctagtgggaagtgttgggtcatgggtgcagacccctcatgaatagatgaatgctctccctggggctagkgggtgtaagtgagttcttactctattagttcccgtgacggttgttaaaaagagcctagtaccttcctcctctctcttccttcctccattgccacatggtctctgcacccaccagctccccttctgccatgagtggaagcagcctgaggccctcaccagatgcagatgcccaatcttgagcattccagccatcagaattatgaggcaaataaaccttttctctttataaattactcagcctcaggtattcctttatagcaacacaaaatggactaagagtgttttaaatatccttttctta

SEQ ID NO: 204253 - DNA, 601 bp, Human
aaacaaagagccgtgccagatagtaatctattactacacatgattgtctctggaatagtttattagcacaataaagtaaaactatttgtttactttcaacttttaaaatcaacctgtaaccaaagataagacaatttatatctttttctctaacccaagattgttatcagtcttgaaaacgtaaaagcacaaatttcagaaagtactgagcagcactgaagagcaaagtaaggctgtttctacaccttggacatttgtcccctcaaaacctcatgttgaaatctgatccaagatcttcgasgtggggtctagtgggaagtgttgggtcatgggtgcagacccctcatgaatagatgaatgctctccctggggctagggggtgtaagtgagttcttactctattagttcccgtgacggttgttaaaaagagcctagtaccttcctcctctctcttccttcctccattgccacatggtctctgcacccaccagctccccttctgccatgagtggaagcagcctgaggccctcaccagatgcagatgcccaatcttgagcattccagccatcagaattatgaggcaaataaaccttttctcttt

SEQ ID NO: 204254 - DNA, 601 bp, Human
aaatgcctatggcctaaaaaaataaccctgaagaaacagataatttggagaactaaagaaagttaaactgaactctaattagtatcttcagagagatgtgtgcaactcttacattcctaaaccaagaacaggatgctatgaaaaaggaagagttaaaaactaggaaatgttgatggaaattaaaacagttgcaaaagataaaacatccactccaagtctggagtcaagaaaaacttcctcaacatagataacaagacaaagctatggaaaatgtaaggcaaaaaaataagacagagcatcrtcattccaggaagcctgaaaagcaagaataaaaaacacggatgttttctgtggggggaatagtaaagaaatagtaaaataaagatattgtcagatatataagaactcagaaagtttatctcacatgcgccctttctttgaatgttacttaagaactgtgctctaatttaatgagggagtaaatgaaacaaagatgaagatcccaagaaacattggactaaactaagaggcacagccaagatttggacatccatggggacagtggaaagcaggtctagagagctgtaggtccaggctgtgg

SEQ ID NO: 204255 - DNA, 601 bp, Human
tggagcgggtgcaagtatcagaagacaggaaactaaaagccaacaaagggaagatcctgaaggcccaggaggactctgacacaggggaggcttgggcaagggctggaggttggacaagggatcccctcaaacccaacagatagatttttactcttccccacaaaaagggaggctcccctctgagtatatgaaatgtaccatctgtgaataagtagaatcctcaagcaaagcctctgggccctacagtggggagtcccaaagtgtcacagttggctcctgcctgctaaggtgaaacgatgtyttatgaccagtgagctgtgcccagatacccatggcccagccaagggtccacaatcccgttcttgaatatgaaagacatcagaccatttgagaaatgcctatggcctaaaaaaataaccctgaagaaacagataatttggagaactaaagaaagttaaactgaactctaattagtatcttcagagagatgtgtgcaactcttacattcctaaaccaagaacaggatgctatgaaaaaggaagagttaaaaactaggaaatgttgatggaaattaaaacagttgcaaaagataaaacatcca

SEQ ID NO: 204256 - DNA, 601 bp, Human
gcccaacagcgcccagtcactccactccccaaagcctccagggacgctgtcaccaggagacgccttggtccccacccagccaccccaagttagatgcccaaggccagtgtctaactcccagtccagggagctctccaaacacctgccctcccgtacccacagcatggtactgtggctgtgatgctgtgtccccgagcctccttgtctaccagcctagccccactgccccttggctgtttgttgcaaggagcctgccctgctatcctctccctcacctccttcaggtcctgcagcagctgcyaccttctccaggaggccccagcccaccccgcctcatcctgctccatcccctggcagcacatcccctcatcttaaccgcagctgccactcctcgtcccccccgccggcacgctccttcaggataaaggtttagggtttccttctctgctgtgcctgctgcacccacaccctacagcccaggtgaccagtattcctggtgtgtctaggactgaggggtgtcccaggatgtgcaccaggatgggcagtcactccacaacagggccgggcaggtggtggatgttcaatacatgtctggtaaatg

SEQ ID NO: 204257 - DNA, 601 bp, Human
gggcagcaccagggagtctgtgtgtgacatgtgtcacacgcgatgcccagcccaagtgtggtcagcagagggtgaataccagctctttctgaagggatcgcaggggcttaatgaaattagctgcctcaaaatgccccattgtggccctgctggcagcctaaggacagatgtgcttgggaaaaatgtgttggctccaatctcaagaaccctgcttcggtctgaaacccaagtagaagcctccgttgagggaggacagagcagggcatcagggtcgggctctgagggggctgctgcagccacmcctgcagaacccctgtaactcaccctaggacaggagggaaataagtgcgtccagaaacttgctccgatcctcagctttcagctcaattactgaagtaatgaaagaaaaacagccgtgagaagggaggagtgggaacacaagacagggcacagaactcccctccgctgcctgccctccactgcattccaaagtgcgcggctcctcccggcctgtggtattctgcactcagtggttgtgtctgtctcactgtacttcatcttcacaactgctgtctgcactgctagagaggtcagggttggg

SEQ ID NO: 204258 - DNA, 601 bp, Human
ttctcatgagccaagcacacaaaagcccggatggctgctctgcgggctcttgcccagcgcctgacacgaaggctgtgggacaggaggctccaggtggccttcgagggcagcaccagggagtctgtgtgtgacatgtgtcacacgcgatgcccagcccaagtgtggtcagcagagggtgaataccagctctttctgaagggatcgcaggggcttaatgaaattagctgcctcaaaatgccccattgtggccctgctggcagcctaaggacagatgtgcttgggaaaaatgtgttggctccawtctcaagaaccctgcttcggtctgaaacccaagtagaagcctccgttgagggaggacagagcagggcatcagggtcgggctctgagggggctgctgcagccacccctgcagaacccctgtaactcaccctaggacaggagggaaataagtgcgtccagaaacttgctccgatcctcagctttcagctcaattactgaagtaatgaaagaaaaacagccgtgagaagggaggagtgggaacacaagacagggcacagaactcccctccgctgcctgccctccactgcattccaaagtgcgc

SEQ ID NO: 204259 - DNA, 601 bp, Human
agccccaacaggagaacaggtgcttgcccctggagggatggacagatggatggatggacggacggatgggagagtggggaggaccccaggcctggcctgagggacctcctgcaacagagtcttggcagggcccatctgccacagccgcagcctccaggctagggctctgggagatgcagggctggatgtggcattccctgtggggaacctgggctgagagatggttacaaagacacaaggcaggcctatttcctgggaacccttaagaaagaggtagcacatggggcagtgggaggtgtcscgggacagtgacctgccagtgaatcccaatggggccctcaggacagctgtgtgctggtgaaggccccagcagaaccagcgctttggaattcccagctaagcggctgccaacagctttgctttctcatgagccaagcacacaaaagcccggatggctgctctgcgggctcttgcccagcgcctgacacgaaggctgtgggacaggaggctccaggtggccttcgagggcagcaccagggagtctgtgtgtgacatgtgtcacacgcgatgcccagcccaagtgtggtcagcagagggtgaa

SEQ ID NO: 204260 - DNA, 601 bp, Human
actggttttaaatctcaatttttagaaaaataatgtctcagttaactaggtgaagtaactttcgaatttaaacaaacaaacaaaactggtaagaatttgacagcggtcaccagaacagtactctaccaagcataagaaatcctggaattattctatcttgcagaagagggtgaacatcctaaagattaaattaaaaggcacttctaaaaagtataattgtgtttacccaacttcctagggaaatgtctttgttaaaaagctgcatttcattcattcatattccggatagtgggcattttctaataaaaagtaaaatctcagtaaatgggctacagttttgtttattcctagaaaggctctcttttaaagtgcggtgtctgcaacgttgttatgacaataagtcaaattcttattgatattccaagtataaaataatccgtagcaatgttactaaaatgtgctcaattttgctcttcaaatatgaaagcgtttcatctgtgtttcagaaacctaactcagctgtagacaatttggttttcccttttaacttaaacttgttttactaagatcatcaacagattgtcagtttcccaagcacctg

SEQ ID NO: 204261 - DNA, 601 bp, Human
acttaatactgtctttaatacggttacagaatttaaaacactgggaattatgaagagagaatttggcttggaagcaatccatgtgaaatagcatttaagagcattgagactctatctgatcctatcaacctgaaaacttgaatcagaaacatattcacttgaaaagacttattgatacctagaaacattggctttttcttcttatattttttttttttgtttctcgtactgctactttaggcttaatatttctggaaatcagggagataacagactggagaactggattccgaagtttagwaaaagcctgaatggagtgtgcgttagtctatgtatgctcctcacatctgtctgtctgtctgtctctgctggggaggttgagagggatagaaagaaaacagccatcatattgatatttctgtgaagctatggactaagcgatctcccctccagcccaagaatttctaacgaacacagacccatatcatcaattcccctagagtcatttttttacactggaggtaggaaataagtgttagaatatgcatttaggtgtttacagaatatggaagggtaagttttaaggaaaggatttgggtag

SEQ ID NO: 204262 - DNA, 601 bp, Human
agtcagagtgaaagtgactgcatttctgacctaacaactggagtggaggagaaagttctaagtgtgaggcagaagtgaaagctgcagggaaaagttagaaaatatgacagaagaatttttctatcatttcttcacctctctcattggacttcttagtttgcaagaactaataactccagggtataaaaatagcttttgtagaatccgaaactactcacaaaaggggtcctgtaaggaagccctatataatccacaaattcattttaagaaatcatattttcaaagtttgatatactaaccmaaataaacaatcaataggcagatcaccatacaggaaagaaaaatctgcctcaagacatgtttgagacactaagaatgtgcccttcagccaggcagaaaccaggctaacctgaaacagacagaagttaaaaacatttgataaaaatattttattttgctatgtaaaagctaaaaattgtaactgttaagttttgtagggagatacatcacaagggaggggaggttgcagaagggaccctatttccctctggagaagaggcagctgagctccagcagccagcctgccccctctagccctagg

SEQ ID NO: 204263 - DNA, 601 bp, Human
taatgttttgaggctacctatttatttcccaaggtaacatctttaagttttaaaatgtagacactggggattattacttccaaagcaggggagccagagccagagcaagcaagcactgcattcaaggaattacaagtagccgcctgtagatcagctgagcgttgacaagccagaaactcatctttgagcttttctgtcttggaaatatgaactcagcccaagaacgcccgtggcatcttcaacaacagggatgcaagccatctcaaactgctgtttgcattattacaatcccacaaaagtrcatggggcccttctatgaaagagagaataaggaaaagagaaagttgttcaacattagaaatatacttcatacagtcagagtgaaagtgactgcatttctgacctaacaactggagtggaggagaaagttctaagtgtgaggcagaagtgaaagctgcagggaaaagttagaaaatatgacagaagaatttttctatcatttcttcacctctctcattggacttcttagtttgcaagaactaataactccagggtataaaaatagcttttgtagaatccgaaactactcacaaaaggggtc

SEQ ID NO: 204264 - DNA, 601 bp, Human
cccatcaccacgctagcccacaaggtcatcaactctatcctcaattactaaaggagcttactagtctgctgcaaactattctgacccctccaaccttttcctcacaaacagctaaagtgctctttttgaaatgcagatctgatcatgtcctggttaaatccctgcaaagattttcccattgctcttagtataaagattaaatcctttaaggttgtctaccaggtcctgcaaaatttgttccctgacctcctgtctagcctcatttaacattgtgcttacccttttactgctccaacgccaytggacttcttttagcactttctgttgaccatattcaacctgccccagggcctctacagaggtcttccttttacctcatatataccgtccctccttactaatatttactcatccttaagatctgagtacttccttggaagagccttccttaaaccccctatctggccaaatcctctacttacaagttctagtcaggttcatagcaattaccatagttttaagggcacatttatatgtgtaattgtttgattaatcaaataatcttgaaaaaaaccctgttctttgtcaaccccactagtgt

SEQ ID NO: 204265 - DNA, 601 bp, Human
tctccccatcaccacgctagcccacaaggtcatcaactctatcctcaattactaaaggagcttactagtctgctgcaaactattctgacccctccaaccttttcctcacaaacagctaaagtgctctttttgaaatgcagatctgatcatgtcctggttaaatccctgcaaagattttcccattgctcttagtataaagattaaatcctttaaggttgtctaccaggtcctgcaaaatttgttccctgacctcctgtctagcctcatttaacattgtgcttacccttttactgctccaackccactggacttcttttagcactttctgttgaccatattcaacctgccccagggcctctacagaggtcttccttttacctcatatataccgtccctccttactaatatttactcatccttaagatctgagtacttccttggaagagccttccttaaaccccctatctggccaaatcctctacttacaagttctagtcaggttcatagcaattaccatagttttaagggcacatttatatgtgtaattgtttgattaatcaaataatcttgaaaaaaaccctgttctttgtcaaccccacta

SEQ ID NO: 204266 - DNA, 601 bp, Human
gataatcctaaaagaaatgttacagcaaggctttaaatgaagaatgccagaagaagctaaaaaaattagatataagagactttagagtgaaataaaactgtagtacagaaaggtagtgtttaacatcagtctttacagacagtgtctgggttcaaatcctaatttttgtccattgggcaagctactcaatgtttctgtgcctcatctggaatagaatagtacccatatcagtgacatactgttgagtattaaatgacataatgtatttaagaactttagaagaatgcctagcatataatgwtgtcccccaaaaatgaaaactattattacatttactcttcaactaatttgaagaaaattttggatttctttaaatacaatcgtttttaaaaatatatcttcaaatgaaaaaaaactatcatcactacaggtggcattatataataatactgcactctcatttttttccacaatcatgacacatatgaaaaatgatattctatagaaatatatagtagagtcaactgtagaggctactcagaagaggcgacagccataccaaactccactacactcgttgtccaaggactaaaaagatggc

SEQ ID NO: 204267 - DNA, 601 bp, Human
agataatcctaaaagaaatgttacagcaaggctttaaatgaagaatgccagaagaagctaaaaaaattagatataagagactttagagtgaaataaaactgtagtacagaaaggtagtgtttaacatcagtctttacagacagtgtctgggttcaaatcctaatttttgtccattgggcaagctactcaatgtttctgtgcctcatctggaatagaatagtacccatatcagtgacatactgttgagtattaaatgacataatgtatttaagaactttagaagaatgcctagcatataatsatgtcccccaaaaatgaaaactattattacatttactcttcaactaatttgaagaaaattttggatttctttaaatacaatcgtttttaaaaatatatcttcaaatgaaaaaaaactatcatcactacaggtggcattatataataatactgcactctcatttttttccacaatcatgacacatatgaaaaatgatattctatagaaatatatagtagagtcaactgtagaggctactcagaagaggcgacagccataccaaactccactacactcgttgtccaaggactaaaaagatgg

SEQ ID NO: 204268 - DNA, 601 bp, Human
taagtaggcagtattcactctattttacaatgagactaccaagtttaagaaaattatgttaactcaccccaggtcttatgtttactaagtggcagagttgaatttttaacccatttcgtggttgactgcaaagtctatgtcatgaacacatcaatactacccccaaatacagtcatgcattgcttaataatggagatactttttgagaaatgcattgttaggtgattttgttgtgcagtcaaagaatgtacttacacaaaatgatatacacatttttatttatatatattttttcatatakaaagccaaagttcccatcaccattactatgctactactgtgcagtggaaattaatctcatgcactatgggcaccaaaacaagaacaaaaacaatttgttgaaagaagaaagctttaagttttggaacctatggggaaaaaaatggctttactgaggaggactgtttaccccaacctctgaaaggagttgggaaaagataatcctaaaagaaatgttacagcaaggctttaaatgaagaatgccagaagaagctaaaaaaattagatataagagactttagagtgaaataaaactgtagta

SEQ ID NO: 204269 - DNA, 601 bp, Human
tccccatccaagttgttacgctgctccctgaccctctacatttttctcttcccttcttttatgcaattctcctcatttcttttaaaattgtttcctacatcaaaacattatttttacatttttctctctaaaaaatgtaagttggccattacttttctttagctacaatgtcttaaatactaagtgctggatactacaccaagggttgtacacatattaactaatgtaatccttacaatgactatgttaagtaggcagtattcactctattttacaatgagactaccaagtttaagaaaaktatgttaactcaccccaggtcttatgtttactaagtggcagagttgaatttttaacccatttcgtggttgactgcaaagtctatgtcatgaacacatcaatactacccccaaatacagtcatgcattgcttaataatggagatactttttgagaaatgcattgttaggtgattttgttgtgcagtcaaagaatgtacttacacaaaatgatatacacatttttatttatatatattttttcatatagaaagccaaagttcccatcaccattactatgctactactgtgcagtggaaatta

SEQ ID NO: 204270 - DNA, 601 bp, Human
gactgggggaggagaggattgctatttaataaaagtaattgaagagctgtgaatagtgactgattgctgatgagctaatcagaatatcaaggaagggaaataataaataataacttattcagacatcactgtccaagtaaacagccggatatgccaaatgaaatttaatctgattatcatactcaccttaaaagcaaactgtcaagtctttctctgtccactacttcatttgtctctttcatattccactgtaagggggatgaaagactttgttttcagaagttggttatatagctcacgygtccggcatcccttcccttctcttaccatccccatccaagttgttacgctgctccctgaccctctacatttttctcttcccttcttttatgcaattctcctcatttcttttaaaattgtttcctacatcaaaacattatttttacatttttctctctaaaaaatgtaagttggccattacttttctttagctacaatgtcttaaatactaagtgctggatactacaccaagggttgtacacatattaactaatgtaatccttacaatgactatgttaagtaggcagtattcactctattt

SEQ ID NO: 204271 - DNA, 601 bp, Human
aagagatattactgtttcccaaacctgaataatttgctgactgggggaggagaggattgctatttaataaaagtaattgaagagctgtgaatagtgactgattgctgatgagctaatcagaatatcaaggaagggaaataataaataataacttattcagacatcactgtccaagtaaacagccggatatgccaaatgaaatttaatctgattatcatactcaccttaaaagcaaactgtcaagtctttctctgtccactacttcatttgtctctttcatattccactgtaagggggatgraagactttgttttcagaagttggttatatagctcacgtgtccggcatcccttcccttctcttaccatccccatccaagttgttacgctgctccctgaccctctacatttttctcttcccttcttttatgcaattctcctcatttcttttaaaattgtttcctacatcaaaacattatttttacatttttctctctaaaaaatgtaagttggccattacttttctttagctacaatgtcttaaatactaagtgctggatactacaccaagggttgtacacatattaactaatgtaatcctt

SEQ ID NO: 204272 - DNA, 601 bp, Human
gccactgtgctcaccaggttcatggtaatctacattacaattatatctgggtgtgagttttactctagttcataaacacaaaaacaaaacatcatatgcatcttgcatttacaaagcccaagctaagaaggcattcacacaattagccaggatatcactgtacataatttaatcatcttttcaatgttcccccttctaaatcatcaaagcctaaattaatccaaaggtggctggcatgccttcaccttccctagaaaccatatgacagttaaagtttgtcttaagattccatgattcattytgagtcttgtagcggcatgactacatttcatctggcctggggcaagcactctctgaagagatattactgtttcccaaacctgaataatttgctgactgggggaggagaggattgctatttaataaaagtaattgaagagctgtgaatagtgactgattgctgatgagctaatcagaatatcaaggaagggaaataataaataataacttattcagacatcactgtccaagtaaacagccggatatgccaaatgaaatttaatctgattatcatactcaccttaaaagcaaactgtcaagt

SEQ ID NO: 204273 - DNA, 601 bp, Human
atgatgtgcttaaaccaagtcccacatattgagggagaaactttaataatagggaaataactatttatttttaattgtgtgtccaatatcatggatccacttgactaacttcttgtatagaaaagtattgtattctgtacattgacaagtacagaatactcattgaaaaaggctagtattttaaagtttaattttcattagaaaaggaccaatgcatttttttatgtgagaatggatttctctaggacggaaaaatatgactcaatatttaaaatatgtatcctacctacaacttttcaarattaaatctaatgtgtaaagatatgtcaaccttgtagagactggttcttggacatcctccaaagacactggactatcctcaggaatcttaaaaggaagagaacgccactgtgctcaccaggttcatggtaatctacattacaattatatctgggtgtgagttttactctagttcataaacacaaaaacaaaacatcatatgcatcttgcatttacaaagcccaagctaagaaggcattcacacaattagccaggatatcactgtacataatttaatcatcttttcaatgttcccccttct

SEQ ID NO: 204274 - DNA, 601 bp, Human
aaaggcaagacacgatgccacgaatgatgtgcttaaaccaagtcccacatattgagggagaaactttaataatagggaaataactatttatttttaattgtgtgtccaatatcatggatccacttgactaacttcttgtatagaaaagtattgtattctgtacattgacaagtacagaatactcattgaaaaaggctagtattttaaagtttaattttcattagaaaaggaccaatgcatttttttatgtgagaatggatttctctaggacggaaaaatatgactcaatatttaaaatatktatcctacctacaacttttcaagattaaatctaatgtgtaaagatatgtcaaccttgtagagactggttcttggacatcctccaaagacactggactatcctcaggaatcttaaaaggaagagaacgccactgtgctcaccaggttcatggtaatctacattacaattatatctgggtgtgagttttactctagttcataaacacaaaaacaaaacatcatatgcatcttgcatttacaaagcccaagctaagaaggcattcacacaattagccaggatatcactgtacataatttaatc

SEQ ID NO: 204275 - DNA, 601 bp, Human
ttatggctctactccccaggcaatatcactaaaggcaagacacgatgccacgaatgatgtgcttaaaccaagtcccacatattgagggagaaactttaataatagggaaataactatttatttttaattgtgtgtccaatatcatggatccacttgactaacttcttgtatagaaaagtattgtattctgtacattgacaagtacagaatactcattgaaaaaggctagtattttaaagtttaattttcattagaaaaggaccaatgcatttttttatgtgagaatggatttctctaggayggaaaaatatgactcaatatttaaaatatgtatcctacctacaacttttcaagattaaatctaatgtgtaaagatatgtcaaccttgtagagactggttcttggacatcctccaaagacactggactatcctcaggaatcttaaaaggaagagaacgccactgtgctcaccaggttcatggtaatctacattacaattatatctgggtgtgagttttactctagttcataaacacaaaaacaaaacatcatatgcatcttgcatttacaaagcccaagctaagaaggcattcacacaatt

SEQ ID NO: 204276 - DNA, 601 bp, Human
aaaattctaaaacacatattcatgactccaccatggagagtctaggtagatgggttacacaattccgtcaggtaattcacatacaaaactgtgaactctagaagacagaggagccattacagaacccaaagaaatataaactattacctgaaaaccctacccattccaacctccaactgatttacagatacaaccaatttgtaaaaacatgcaagaccttgctggatagtggaatatcccaactagaaggacaagaaacaggtggccaaattcttctctacaatgttccaaagaacaatgyatttgtggatatgacaagcaacatttagatttaactgcttcccatcaccagctcctgagcaaggtactttcacatatactgtctaattcaatccttacaaaaccaaatcatctattaatgtgtctgaagattataggggcttaatcttaaagcataatgaagtaaatcctgcaggcaagcagacactctatagaactctccatttctccatgaactgggtagttaccataaagaaagaatggggtgagtgcccaggcagcttctcttttgttccttcctttattctagctcagtggttct

SEQ ID NO: 204277 - DNA, 601 bp, Human
agggtttttcctgatggctatgttccaaaagcaacatgctggttacataggaagcacgtaggcagctcccccaaaatacatattcacatgtacccccaaaatatacatagtaaaaaattctaaaacacatattcatgactccaccatggagagtctaggtagatgggttacacaattccgtcaggtaattcacatacaaaactgtgaactctagaagacagaggagccattacagaacccaaagaaatataaactattacctgaaaaccctacccattccaacctccaactgatttacagrtacaaccaatttgtaaaaacatgcaagaccttgctggatagtggaatatcccaactagaaggacaagaaacaggtggccaaattcttctctacaatgttccaaagaacaatgcatttgtggatatgacaagcaacatttagatttaactgcttcccatcaccagctcctgagcaaggtactttcacatatactgtctaattcaatccttacaaaaccaaatcatctattaatgtgtctgaagattataggggcttaatcttaaagcataatgaagtaaatcctgcaggcaagcagacact

SEQ ID NO: 204278 - DNA, 601 bp, Human
aattaaaattttaaaaagttgttaaacccaggttattaaaaacaaacaaaacctcaggtgatcatgtcagtgacacctaggagtacaaatcaaaatccacagcaccccccaaaataagctactgaatttgtattcaatttaaaatatatgtcaaattaagaatattaattttatctactaaatgaccaatcttatgaatttctctaataaatggcttatttaataacggaagttatgtatttttaaatccagatgaataatacaggaggcatttcccaataatttaagctaaaacaggatyagaaatgctaatagtctcttgtggcaaaatactccacccccagggtttttcctgatggctatgttccaaaagcaacatgctggttacataggaagcacgtaggcagctcccccaaaatacatattcacatgtacccccaaaatatacatagtaaaaaattctaaaacacatattcatgactccaccatggagagtctaggtagatgggttacacaattccgtcaggtaattcacatacaaaactgtgaactctagaagacagaggagccattacagaacccaaagaaatataaactatta

SEQ ID NO: 204279 - DNA, 601 bp, Human
aaaagagctccccaccttaataaatcagaagtaaaaggcatatttccttttcaaactgaattttcagtaaaaatctgaacttaagctaaattatgaaaaatccaacccttcaaaatgagaaaagaatacaattcaaaacccagattattattattattagtagtagtagtagtgtttttagagatggggtccactatgttgcccaggctggactagaactcctgggctcaagtaatcaatcatcctacctcagcttcccaagtagctaggactacaaccactgctgggaccactgcaaccrgctaaaaccgaggctaccgatttaatcatgacacattgtatgcttgtatcaaaatgtcacaggcaccctttatatatgtacaactattacatatccataattaaaattttaaaaagttgttaaacccaggttattaaaaacaaacaaaacctcaggtgatcatgtcagtgacacctaggagtacaaatcaaaatccacagcaccccccaaaataagctactgaatttgtattcaatttaaaatatatgtcaaattaagaatattaattttatctactaaatgaccaatcttatgaatttc

SEQ ID NO: 204280 - DNA, 601 bp, Human
gtaggaccaagcatgtggaagtaaggaaaatactttgggcatgagaaaaggaaaggaaagtgaagacagcaacagttagtggagtatagcaaacttaactttaaaagagctccccaccttaataaatcagaagtaaaaggcatatttccttttcaaactgaattttcagtaaaaatctgaacttaagctaaattatgaaaaatccaacccttcaaaatgagaaaagaatacaattcaaaacccagattattattattattagtagtagtagtagtgtttttagagatggggtccactatgytgcccaggctggactagaactcctgggctcaagtaatcaatcatcctacctcagcttcccaagtagctaggactacaaccactgctgggaccactgcaaccggctaaaaccgaggctaccgatttaatcatgacacattgtatgcttgtatcaaaatgtcacaggcaccctttatatatgtacaactattacatatccataattaaaattttaaaaagttgttaaacccaggttattaaaaacaaacaaaacctcaggtgatcatgtcagtgacacctaggagtacaaatcaaaatccac

SEQ ID NO: 204281 - DNA, 601 bp, Human
gagcataactgataagatacaatccaagaaaaggtagaatgggtaggaccaagcatgtggaagtaaggaaaatactttgggcatgagaaaaggaaaggaaagtgaagacagcaacagttagtggagtatagcaaacttaactttaaaagagctccccaccttaataaatcagaagtaaaaggcatatttccttttcaaactgaattttcagtaaaaatctgaacttaagctaaattatgaaaaatccaacccttcaaaatgagaaaagaatacaattcaaaacccagattattattattaktagtagtagtagtagtgtttttagagatggggtccactatgttgcccaggctggactagaactcctgggctcaagtaatcaatcatcctacctcagcttcccaagtagctaggactacaaccactgctgggaccactgcaaccggctaaaaccgaggctaccgatttaatcatgacacattgtatgcttgtatcaaaatgtcacaggcaccctttatatatgtacaactattacatatccataattaaaattttaaaaagttgttaaacccaggttattaaaaacaaacaaaacctcagg

SEQ ID NO: 204282 - DNA, 601 bp, Human
atcctattctcccttgggctactttaggtaagttccttgtggattcagctcagcccaagaactgcccatgggatttgtcctagcttctgtgtgtttgttttgtttgttttttgtttttgtttttttgagatggagtctcactctgttgcccagtctggtgtgcagtggcgtgatctcggctcactgcaacctccgcctcctgggttcaagagattctccagcctcaacctctggagtagctgggactacaggcatgcaccaccatgcctggctaatttttgtatttttggtagagatgggrtttcaccatgttgggcaggctggtctcgaactccaggcctcaggtgatccgcctacctcggcctgccaaagtgctgggattacaggtgtgggccactgcacccggcctgtcctaacttctggacctgaaatgcagtaagaaagaatgctcaaaaggtaagagggacagcaaaagcaaaacaacatgttaataaatacattaacatatcaaaagcagaggatgattcagcaaagaaagagagaagcagtcacagaggttgaaaaatgaagtctgaagagtaacataagccaacagaagaga

SEQ ID NO: 204283 - DNA, 601 bp, Human
cctacaagtacccagcaggtttcatctggcattatcatcttatcacataaaattactgttcttttcaaaacattttaatattactattatttttatagacattttggttgctccgaagttagagaaactactattctgctgaggttcatgaacacatgtagttaatattctgtgtgaaggatcataaagccaaaaaaaaaaaaaagaaatattaagtgcaagttcataatggtaactggtattttgaaaacaactaatattttgactgttaagtaatgccttttctccataatgaaatgcrttatttcaaaggtcctggaatattgctgatggtcacatttatagatactgaagaaaaatttagaaggatcaatcaatcatttacaggtcaagtcatctttccaatagaaaacaagtgccactaagtaatagcaaaacatatcaatttggttttgcaacaagaatcatccaaaattaaccaaaatatgagtttttccaaggttacatactgctatttaaaatgatacatgttaaatgtacgtttttcagtattataaataacttgttatagtaaccacagtaggacaatttttataagtgg

SEQ ID NO: 204284 - DNA, 601 bp, Human
ccttagaaatacacaggtatttgtaggtttgtttcaaagtcacttgagaaaatagatgttgggaaactttgtcccattgtgaaagagatctgggggtagaagtgtccagctgaagaataattcggttccagctataaaaatgttagtgatgcccaacttcagagatgtatgaagaaaatgaagtaagccaggaatcaatcctacaagtacccagcaggtttcatctggcattatcatcttatcacataaaattactgttcttttcaaaacattttaatattactattatttttatagacaytttggttgctccgaagttagagaaactactattctgctgaggttcatgaacacatgtagttaatattctgtgtgaaggatcataaagccaaaaaaaaaaaaaagaaatattaagtgcaagttcataatggtaactggtattttgaaaacaactaatattttgactgttaagtaatgccttttctccataatgaaatgcgttatttcaaaggtcctggaatattgctgatggtcacatttatagatactgaagaaaaatttagaaggatcaatcaatcatttacaggtcaagtcatctttc

SEQ ID NO: 204285 - DNA, 601 bp, Human
gaccagcctggccaacatggtgaaaccccatctctactaaaaatacaaaaaattagcagggtgtggtggtgggtgcctataatcccagctactcaggaggcaggagaatcacttgaacccgggaggaggaagttgcagtgagctgagatcacaccattgcactccagcctaggcaacaagagcgaaactccatctcaaaaaaaaaaaaaaagctacacaaaacatatatttgtcaaatttattttatatataaatgatcctatcatcttttgtgctctcttgaaattttctaaaagagatractgggattcatggtcaagaacatctcaaagaacattctatatctgagacagcatttaaaatggccttgccatacaagttactagtatttgttattataattttaaaagtgatgaaacaattctcctcatacagttgacaaaacttactccctgtataaggtatcttgataattcagaactataatgataggatataaataggatgagaagaaagaaaaataatctaaaggatgagatcaagctaaactgaagaaataagaaaatgtgataatcgaaactctttacctcagtagattcaa

SEQ ID NO: 204286 - DNA, 601 bp, Human
ttccatagtccatatctggagtattccttattgcttttgtaaccacttactgggtgctgaggtagaatgtcaaaagttaaggcattcaaattccttagaatcctatttacagaagaagtaccatcctaccgctttagctaagaattggaatattctttgctgggcctggcagctcacgcctataatcccagcacattgggagggcaaggcgggcagatcacctgaggtcaggagttcaagaccagcctggccaacatggtgaaaccccatctctactaaaaatacaaaaaattagcagggygtggtggtgggtgcctataatcccagctactcaggaggcaggagaatcacttgaacccgggaggaggaagttgcagtgagctgagatcacaccattgcactccagcctaggcaacaagagcgaaactccatctcaaaaaaaaaaaaaaagctacacaaaacatatatttgtcaaatttattttatatataaatgatcctatcatcttttgtgctctcttgaaattttctaaaagagataactgggattcatggtcaagaacatctcaaagaacattctatatctgagacagcatttaaaa

SEQ ID NO: 204287 - DNA, 601 bp, Human
atattatgtgacagcatagagcccagaatcaaataacagaccacgaaagcagtagcaaaaaaaaagggagctcatgctagctaaacaatgtcttgttttcctttactaatagtccagtggaaactctctctccataatgaaaatatatgggtgtgcacgtgtgcttattacaattaccttcaaagcaagtttgaatgtatttagtaaacattaaattttgaaagtactatggtggtacgctgccaatgaatccacagcatataacttcacaattctcacaatgattattcttaatggcatrtgcataagcacaggcacacacacagccccttcactacaaaaatgtccagagaacacttgccagttctttttctgcatcaccaagaacaattacatggctataaagataaaataacaactgagtataagaccctgcaagtttgagctagttttaaatcttaaagccatctgtcttctgaaatctttgagaagaaagtcataaagtattgtcaatatttatgtccgggtgactttgattaggtacccagtatgtttaggtctctcttatagatgctttattaataaactaatcactttaaaa

SEQ ID NO: 204288 - DNA, 601 bp, Human
aaaaacatgatacagatgtatgacacattcatcatctagaaatggaaaatgactaagccactatgttttgtttgtaaaaataatacttcctttctgtagcatcagtttaaattacaggcacccacacaacattttagaggagtgccctttgcctttccctttcgcatttgttacttgcaaaacaaatagctcttcaacagaggcaatttaggcagtatttacacctatgcttcctttcaaaaacaacaaatgacacagagaattcgaagctataggttcttgttctaaacgtgagctatayaaataaagctgatggggtccactccaacacctacagaggctattactaacagttaacacatgttgcagtcacatatgcccaggcagcactcacaaaccataagcttaaagcatgttgttttccttaagagcaagtcttgaaaatcaaatttaaacactctaagaatccacaacactaagatctaataatctctgaaatatacatgtgtacagtgccatgctaatcaagccaaggtaacagggtctggcctctctgtgtatcgcatggttttgcaatcttctacggctgcaaatccattac

SEQ ID NO: 204289 - DNA, 601 bp, Human
ctttcagcaatctgctgaactgcatacttgctggtcagttaccttggcaactccacagtaaaggctgcttcactttaagtatagtatgccattcactttgagaaaaacatgatacagatgtatgacacattcatcatctagaaatggaaaatgactaagccactatgttttgtttgtaaaaataatacttcctttctgtagcatcagtttaaattacaggcacccacacaacattttagaggagtgccctttgcctttccctttcgcatttgttacttgcaaaacaaatagctcttcaacrgaggcaatttaggcagtatttacacctatgcttcctttcaaaaacaacaaatgacacagagaattcgaagctataggttcttgttctaaacgtgagctatataaataaagctgatggggtccactccaacacctacagaggctattactaacagttaacacatgttgcagtcacatatgcccaggcagcactcacaaaccataagcttaaagcatgttgttttccttaagagcaagtcttgaaaatcaaatttaaacactctaagaatccacaacactaagatctaataatctctgaaat

SEQ ID NO: 204290 - DNA, 601 bp, Human
attgcctttcagcaatctgctgaactgcatacttgctggtcagttaccttggcaactccacagtaaaggctgcttcactttaagtatagtatgccattcactttgagaaaaacatgatacagatgtatgacacattcatcatctagaaatggaaaatgactaagccactatgttttgtttgtaaaaataatacttcctttctgtagcatcagtttaaattacaggcacccacacaacattttagaggagtgccctttgcctttccctttcgcatttgttacttgcaaaacaaatagctctkcaacagaggcaatttaggcagtatttacacctatgcttcctttcaaaaacaacaaatgacacagagaattcgaagctataggttcttgttctaaacgtgagctatataaataaagctgatggggtccactccaacacctacagaggctattactaacagttaacacatgttgcagtcacatatgcccaggcagcactcacaaaccataagcttaaagcatgttgttttccttaagagcaagtcttgaaaatcaaatttaaacactctaagaatccacaacactaagatctaataatctct

SEQ ID NO: 204291 - DNA, 601 bp, Human
ttatataaaattatctcctattgtaaaagctttttaaaagctcttacctaatgccatttttcattctcctctacaacatatgtatagttttccaaaaatcaatgtactatgtgagaatctaggtcttaatatagaaaatcataagtttacagctataattatttccatgtgaatataggtagatcacttgtcagagacataaaactcaagactgagaatccagaaatatgctttccttaacattcaaaaataaattatttttgtctgtaattaaatttctaatctgtaaatgagaaatatyctacaacaatttatcacatatttagaccatttgaaataatgttaatgatattttatcatatatgtctatattatgcaaattaaacaaaaaatttagtacgttaactgcttttttttcctcacaaagaacataccaggttttgggtaaggtggaaattcccccttaaaatattctctttccaaaacatgaacaaagaggacacctgctgatgggtatacattccgatcggagtgtaccttggagaaaatactgtacactgaaaacaaagaggaaagataagtgacagaaagacaaataatg

SEQ ID NO: 204292 - DNA, 601 bp, Human
acataagacagttattttcacacatgttgctttggtagtttcaatcaaaacattctgtctaaaatttttttcttacatttgtagccaactaaatacacacatacaaaacccatctgggaatttaaattagggcaccacgttaaaaaaaatccttttggttgtttaatttgtttcaaaatctgatgcaacaaagaaagcagattcatacaattttcttggaaatatatttttggtcacctaacagtgatatagttctgccagtgagacaactatctttcaggagaattccctaatcatgctratgtactcattcttttgcgaaatattccgttcatgaaactctggacactatcatatgagtatgaaagatattccaaaattataaaagtctcatcaaaacaaaaataatgtaattttaaaacactggaggataggatgaaaaagacgttacaaatccataacaactgtactaacgacagcatttattaatcacaagcaataataacagcatcatttattagcacatcctggccctgtgttaaatgctttacaagccgtatttcatcttcttgaatactattaggaacatggctaactatat

SEQ ID NO: 204293 - DNA, 601 bp, Human
aactctgcatcaaacagcaccttcttactatagcagttattacagtgttggctaagtatttgtttacatcccagtcctccaacccctgaattgtaagaagactgggcaagattcacctattatttatcattctatccctaagcacctatcacaatgcttggcaagtagcaggggtatatgtctgttgatggctatatttcaatgaacataaaacttgaattcaaaatacagagcaaataagtctatcaagtctacaattattttctcaaatagaattcatattataataatctcttttaargtcatatttttttcacaaatttagactgtcatttttaatataaaagctgaaacaaaaactttataaacagagaagaatggcacatttccaaatgttatctactgtgtttccatgcacaaaatattaaaaaccaccatcaggtaactttagtttcaacacttaaaactcaaattacaatacacacacacacacacacacacacacatatatgtatagttttgctctttctaggtgtaaattacctcaatgattgttggcttccccacattttcagctgttggggacccatataggactcca

SEQ ID NO: 204294 - DNA, 601 bp, Human
atttgcagagccaatagacttacatcaaagtcaattcagaaacagccagtgcaaacaacacacaaagcaaaggccaacaacaggatatggcttcaaaacttaaggcctatttaactttataacagatattaaatcattcggacacatctgcagtacctcaaaaaaaaaaaaaaaacaaatgattgtgtcaaaatcttagaatcccagcactaaccttctggcaatgattgcagctggaggtgacactgagacaaaagagtaggataaaactgacttcaactaaaaataaatatcttgtgcrttttaaaacaaatatcaaagatttttatacattacatgtgtcaaaaaataagttgcagtcattgaaaatactgagttagaacagtaagaattttgaaataaataattttaaacttttaacaatgtttaaaaggtatatattttgaaaggcatattactccataaagttaaaagaacctctctctccaggatttgccaaatttccatcatatttaattatttccttgctgttatctgttgggacacatgatcaattaatttcacaccggacattaaaattaagactagccattaaacaaac

SEQ ID NO: 204295 - DNA, 601 bp, Human
gaaagaatgttaaagatgaagaaatagtttcctagaataaagttacagcagtctgtgcatccttctgcagctaataactggggcgtcaatttcctttgaaattcatggccctaaataatcagcttcttaatggaaggtacaaaagacttagtgctataatttatgatgctgatcctcatctacaattagatttcacagaccaggaacttgagatataaaaaaccactaacacaacatctttgccaatatagaaaattactagtatgttcatatctttacaatatctatttcttattaaaamgaaaaatgcaataggccatcttccatctataataagtttgataagatcaccgtatttaaaaatctatatttaaggcaatgagataaagatctgcttacccctccttcaggtcattaatgggaagtggcaccctgccacccctgtctagggccgatgtgatgtttatggcgttcaggcgctctggctgccacacatttttcactgcgccaagaaagtctccaagaacctcactggccaacatttcttctacattcatattcttaatgaagaattctgcttgatatggcaacgggaagtcta

SEQ ID NO: 204296 - DNA, 601 bp, Human
cagggaagatacccccattcatctcattccacggttctgctttaattactttataggaaagagaaccatgttgtaactgtaactatgaagtaaaaatttaagctctagaattatgttttcatatagaaagccaactaggtacatagacaagagataaagcaaccattttcctcaaaggacttctatgtatgcttgactgatttcaaaatccattgctataaaacagaagataaaatttaattctgaaatttttaagttggactttacagctcactgtttttccccatctgccttttaccttcccacagactgcatccatgtgtacatagttctcctttaaagctatccttaaatttaattcttactaatccaggtattctagctaattctagatatcacctgtataaaagtgtttccaggattatgggcgaagaagttgaaaggggaatatgctatgcaaaatgtgatttattccacagactatacttttataggattgaggtaggaaaagcaaatctgcctcaacctacagattaaaaattaaagatcaaagtttgtcttgataataactttacccaggcaggattctttcttgacctcc

SEQ ID NO: 204297 - DNA, 601 bp, Human
atgttgttttcctttcagctagttgttgtcaaaatttaaaatttgtatgaagtgaaaatgagaatgatctttacctttatgaccctagcacatgttttcaaatttcaaatgtgtataaacagatgagacaggaggctattatcaagtataaggctctcaatgaatgctaacaaaacctggtacttcaaaagactagagactggagtgcactagatagagttgtttcttgtgaagaattttttttatcccaacaattcaatttctcttctttgaggtaaaatgcatttattgaggcctttasatttataatgtgaagaaacaagtaatggtaaacaatttaagtagaaactccactgtttccagcaatagccaaatatatggatccaatgattgtattttttcctaattgcccaattaatgaatatactttgttattttatgtatatagaagataaaagacagtttagagaagaatatgtccatatatgttacatgttgcctgggaaatgttgagcactcaaaagcagcagcacaaaacttcctgccttttcctccacccaacttctttctaatgtacatacctgcaattaatcaatcaaaa

SEQ ID NO: 204298 - DNA, 601 bp, Human
acaactgtagttctagtcaccatcaccttccacagggagtgaaggaacagccccttaatggtgctccttgaacccagtctttgccactgtcctcaggtagcctactggctaaatgaatgcatgaatgaaaagcattataccagtttaaaaacaaacggaacacagatgtcatgctcagaagcaggagatattggatttgtctcattaagtttttttaaaaagtatatttatggcttcttttgtagaatcactaagtttgaacacactggcttttaaaaatatgtaattttgtctgagtccrtgtgtaataataataactatgctacacatgctaaaattatgtttttcataatgttgttttcctttcagctagttgttgtcaaaatttaaaatttgtatgaagtgaaaatgagaatgatctttacctttatgaccctagcacatgttttcaaatttcaaatgtgtataaacagatgagacaggaggctattatcaagtataaggctctcaatgaatgctaacaaaacctggtacttcaaaagactagagactggagtgcactagatagagttgtttcttgtgaagaattttttttatccca

SEQ ID NO: 204299 - DNA, 601 bp, Human
catacacacctgtccactttgttttgtcccactgctacaactgtagttctagtcaccatcaccttccacagggagtgaaggaacagccccttaatggtgctccttgaacccagtctttgccactgtcctcaggtagcctactggctaaatgaatgcatgaatgaaaagcattataccagtttaaaaacaaacggaacacagatgtcatgctcagaagcaggagatattggatttgtctcattaagtttttttaaaaagtatatttatggcttcttttgtagaatcactaagtttgaacacrctggcttttaaaaatatgtaattttgtctgagtccatgtgtaataataataactatgctacacatgctaaaattatgtttttcataatgttgttttcctttcagctagttgttgtcaaaatttaaaatttgtatgaagtgaaaatgagaatgatctttacctttatgaccctagcacatgttttcaaatttcaaatgtgtataaacagatgagacaggaggctattatcaagtataaggctctcaatgaatgctaacaaaacctggtacttcaaaagactagagactggagtgcactaga

SEQ ID NO: 204300 - DNA, 601 bp, Human
attccatttatacaaaatgtccagaataggcacatttatagagacagcaagttccttagtggctgcctaggggtaggggtgggggtgggggtgacttctaatgggtacaagggtgggtgtgtggtgttgggataataacaactttctaaaattggttataataatgattgcatgactgtgaatttactaaaagtcacgatttaaaattgtacattttagataggtgcattgtatgatatgtgaattatatctcaataaagctgttatttttttaaaatgaaatgaaataaaagtacagcasaaaagttcaaagctatgtaaatgtaaatatgaagtcatgaccaagccagagatgacaactgtgttcgagaatatgttcacacaaattcatttgctctacacatcaaatttatattaggatttaagactcatttgaaagattatcttttaaaaaacctattgtacctttgggaaacaaatagtaaataatgggcaaaattaaagatcaaattaaaaattcagaacaaaagtagagatgagaaaccattggtatttagatgatcagaggatataaacatattcgatttaaaacaagttatta

SEQ ID NO: 204301 - DNA, 601 bp, Human
aactctcctattttgctggtggaaatgtaaaatgcatctgctttggaaaacagtctggcaattcctcaaaatgttaaatacagagttaccatatgacccagcaactcgattcctagggatatacttcagaaaaatgaaaatatatgtctacacaaagacttgtacatgaatgttcacaatgacatcattcatggtcaacaagtgaaaacaacccaaatgctcatcaacttataaatggataaacaaaagatggcatatccataaaatagaatattattccatgattaaaaatgaaatactratttattctacaacatagatgaaacttgaaaatgttatacaaagtgaaagaagccagtcacagaagaccacatattatataattccatttatacaaaatgtccagaataggcacatttatagagacagcaagttccttagtggctgcctaggggtaggggtgggggtgggggtgacttctaatgggtacaagggtgggtgtgtggtgttgggataataacaactttctaaaattggttataataatgattgcatgactgtgaatttactaaaagtcacgatttaaaattgtacattttag

SEQ ID NO: 204302 - DNA, 601 bp, Human
tggtgaagatatggaaaagttggaactctcctattttgctggtggaaatgtaaaatgcatctgctttggaaaacagtctggcaattcctcaaaatgttaaatacagagttaccatatgacccagcaactcgattcctagggatatacttcagaaaaatgaaaatatatgtctacacaaagacttgtacatgaatgttcacaatgacatcattcatggtcaacaagtgaaaacaacccaaatgctcatcaacttataaatggataaacaaaagatggcatatccataaaatagaatattatyccatgattaaaaatgaaatactgatttattctacaacatagatgaaacttgaaaatgttatacaaagtgaaagaagccagtcacagaagaccacatattatataattccatttatacaaaatgtccagaataggcacatttatagagacagcaagttccttagtggctgcctaggggtaggggtgggggtgggggtgacttctaatgggtacaagggtgggtgtgtggtgttgggataataacaactttctaaaattggttataataatgattgcatgactgtgaatttactaaaagtca

SEQ ID NO: 204303 - DNA, 601 bp, Human
aagacaaaagccaaaagaatacttcctatctcattctatgaaacccaaattaccttaataccaaaaccagaaaacaacattacatgaaaagaaactacacaccacaccagcatctctcataaacacaggtgcaaaaatcctcaacaaaatattagcaaatcagattcaacaatgtataaaaggaattatacacaatgatcaactgggactttccccagttatgcaaggctagttcaacatccaaaaatcagttaatatcacatcaacaggctaaagaagaaaaatcacatgacagcatcakcagatgcaggaaatgcatttgacaaaatccaatggcaatttgtgaaaaaaaaaattcttagtaaactaggaatagaggggaatttcctcaatttgatacctacagctaacattactctaaatgagaaacttgaagttttcctactagtatcaggaaaaagttaagaatgttgcctctcatcactgttttttaacatcatactggaagtcctaactaatgtaataaaagacaaaaagaaaataaaaagtatacagatttgaaaggattaaatactgtctttctttgcagatgatatgattc

SEQ ID NO: 204304 - DNA, 601 bp, Human
aaaagaggagagaaaacaatcataaaaaatgctcaatgaaaactataaaaagtgggaaaagagtggaagacaaaaatagaaacaaaaaacaaaggcaacaaacagaaaacagtaacaaatatagtagatttatattttattttattttatttttattttatttttgagacacagtctcgccctgtcacccaggctggagtgcagatctcagctcactgcaacctctgcctcctgggttcaagcaattctcctgcctcagcctcccaagtagctgagactacaggtgcccgccaccacaccsagctaatttttgtattttcggtagagatgggttttcaccatgttggctaggctggtctcgaactcctgacctcaggtgatctgcctgcctctgcctcccaaagtgctgggattacaggcgtgagctaccatggctggcctcaataatcactttaaacatcaatggtctaaataccccattgaaaagacagagactgtcagagtggattgaaaaacaagatccaactatactctttataaaaaatatctactttaaataggaagacacatatacattaaaagtaaatgggtggagaaagat

SEQ ID NO: 204305 - DNA, 601 bp, Human
acttatagataagcaaaataaatgacagcaatgatacaagagagatgagggaaagacagggattattttatcataagatacctgcaatacctaggaagtagtgtagtgttatttgaaagtgaatttggattggttatatatgtatattacaaactctaagacaatcagtaaaagacagtttaaaaaatacaactgatgtgttaaaagaggagagaaaacaatcataaaaaatgctcaatgaaaactataaaaagtgggaaaagagtggaagacaaaaatagaaacaaaaaacaaaggcaamaaacagaaaacagtaacaaatatagtagatttatattttattttattttatttttattttatttttgagacacagtctcgccctgtcacccaggctggagtgcagatctcagctcactgcaacctctgcctcctgggttcaagcaattctcctgcctcagcctcccaagtagctgagactacaggtgcccgccaccacacccagctaatttttgtattttcggtagagatgggttttcaccatgttggctaggctggtctcgaactcctgacctcaggtgatctgcctgcctctgcctcc

SEQ ID NO: 204306 - DNA, 601 bp, Human
cttgggaggctgaggcaggagaatcacttgaacctgggaggcggaggctgcagtgagccaagatcgctccattgcactccagcctgggcaacaggagcgaaactccatcttaaaaaaaaaaaagaaaaaaagagacatattcttataaataacagttttacccaccattcccttatataaaaatgtggccactaggctacattatatcagcaatatatgatgtagcataatgctgcattacagcattatatagcatggtctcccaaatgcaactgtacagtttcctcacccctcacccttrtctactccttacaaagtccttctagcctttctaaccctgatccctatagcactagacaaggtttgcactaataaaataggtgtttatagtccaaattggagctgcttgctctgacatacaagcagatcataaaaaacaacccaaacacccttaattctgaggcaaaaatttagattacaaaggtctatggtaataacattttaataggtttaaaccaaataattctaatatctctaaaaataatcaatttgaaatgcttaggatatggttcttttttttataattaactcatctttgagc

SEQ ID NO: 204307 - DNA, 601 bp, Human
tgacttctagtgcttagggcaattgaattcaactcattttaacatttggttaaaaagaaaaaaggccgggcatggtggctcacacctgtaatcccagtactttggaggctgaggcaggcagatcacctaggccaggatttcaagaccagcctggccaacatggtgaaaccccatccctactaaaaatacaaaaattagctgggcatgggggcaggtgcgtataatccgagctacttgggaggctgaggcaggagaatcacttgaacctgggaggcggaggctgcagtgagccaagatcgckccattgcactccagcctgggcaacaggagcgaaactccatcttaaaaaaaaaaaagaaaaaaagagacatattcttataaataacagttttacccaccattcccttatataaaaatgtggccactaggctacattatatcagcaatatatgatgtagcataatgctgcattacagcattatatagcatggtctcccaaatgcaactgtacagtttcctcacccctcacccttgtctactccttacaaagtccttctagcctttctaaccctgatccctatagcactagacaaggtttgca

SEQ ID NO: 204308 - DNA, 601 bp, Human
tcatgctggcccctacagcaattctaagaaatctgtaaaaaacagtttgaaaaccattgatatgaattatttcagccaggcaaatattatgttccaaatacaacaatctaaagtggaaaacagtgcgtgctagttaaatgctgtttaaactcttaatctataggtaacacctttgagagttttttttaatgtttcagttccactttaaagatattactagggaaataataaactcaactctaacacaatttgaggaagttacttaataattcatcccgacgattatattcgtttttattgktacttatcagccttatccttgtgtaggctagaggagtatttcttttttagcttgtttgttctttcagaatttcacacaatgtatttatattggttttggtcacaaaagtaaaaagatcaatttataaactacaaagagggaataagttctacatttaaagatggcaaggcaaatatctttactacagaagtcaaaatgcaattagatgggcatctcacacagggtgggaggatgtgttttattttacctactcaggtataactgatctgggtctattctacactcaaaacgaacacagtg

SEQ ID NO: 204309 - DNA, 601 bp, Human
aggtgactcatttttataacaaagtttgttccttcatcaatctcctgaatgcttacaaagtagcaccaacacatcaatatattgaacagtcttgttgaaacatgttagcatttaattaaagcaagtaatcaaaattgtagggaaaaattctgataaacatcttgtaattgaaatctgatgaacaatttcattatacttgcctcaaatctttgaaaagttgtcaaacgaaaatctccttaaattcacgaaagcagtaatagagaagataatttctgaatgaaaacatccaacacatttctgwatgtgcctgaagtttttaagagacttacttaatagtttccctaccacaatgccgctattcatactcagaattccacacccaacttacatttttaaaacttctcttgcttttccaaaagagctacaaaggcattaatggttccctggcaattagaactaggaatcaaccactaattagaagacaatcatgaataagttatctactcagtatagagatgaatgaaataattggctgtggaaaatttttagggacacttgaaagaaataaagaaagcaagtcttagggaaatagaataatcca

SEQ ID NO: 204310 - DNA, 601 bp, Human
tttcttttttttctttttttgattcagagtctcactctgttgcccaggctggagtacaatggcgtgatcttggctcactgcaacctccacctcccaggttcaagtgatttttctgcctcagcctcccaagtagctgggattacaggtgtatgccaccatgcccagctaatttttgtatttttttagtagagacagggcttcgccatgtcgggcaggctggtcttgaactcctgacctcaggtgatccgcctgccttggcctcccaaagtgctgggattacaggtgtgagccaccgcacccrgcctccatttagttttaaatgtaccagaggcacaaacacaccaatcttgcataattataaaaaaaaatgctagggtggtctctctccctttggcacttaagatattttggggactcactaaataaaacaataacaacaaaacaaccaagaggagatactgtactttagtctataatatgatccaaattgcagaaaaatgtaagaaaacaagaaggtaataggctctagtgttaactaaaaaggagagcaaagctttcttgactcaagcaaaatacctgctccctaaaatctgtttcagaa

SEQ ID NO: 204311 - DNA, 601 bp, Human
agccccttgtattacacaacatgcccaaatctcatttttatggcaacccaagctaaaataccatggagtgcagtgtgcaagtgttttctctttgtggtgtaaggcaaacatgcatgcagcattgcaccagcttttatttatttacactgcttgtggtttgtgtgtccgcagtgtatttcataaaatgaaaacatttaaaagtgtcatttcatttccttgtgtatgctcctaggaagatgtttcttttctttgcaggattacatgttgaaatggattataaaattagtgtatttttagtttstccaaaagaatcccagaaaccctggaaattagtgcgctgtgaagataaaagtgaagcttgttacttacaattttaattttggacttctaaatgtttccccaagaggataaacatagtcttaataattctttttgcacaagaatcgaatcaaaagcttttcctaccagaaacgagaaagagaaaagaatgcatgttttaaataggtaagaagcagcagccagtaacggatgacagaaagggcagagatatctaatacttcttttatgctcctgacatgttcgtgcacacacacaaagggga

SEQ ID NO: 204312 - DNA, 601 bp, Human
taaacttgttaaacaattgcactatttactccctagcctcacccccaaggactttaaaactttttgactgcaaccaaatacaatttgatcattatccaggaggcacatacatctgtataacagaaactttggcaatagtacaggtacttccttctgtcagatgcagtgctttttgatatttcctatttgaatcagttatttctccctattttaaattgtattgagacctccagttgaaaaacatttaattataggctacaaagtgattggcaaggtttcttgtaaagggccggttagtaartgttttagacttagggcaacatgtggtcttgatcacttcttcttcagtttttttttttaaacacatacaccttctgagggttgcggttgtacaaaattagctgcagatcaaggccatagcttgccgacccctggttagaagaaaaaaaaaaaagtcaaaatagtaccattgggggaaaaaacaggagtgatcctaaaaagtatgagcctatcagtttgacatctatgtccagaaatgtgtctcattagaaaagaaccccagatactgggcaattctggcatagtaaagaataaggattgg

SEQ ID NO: 204313 - DNA, 601 bp, Human
agctaagagctccaggattttgtaattaatgagactttatagtttttggctattagagatttacatggtggttttaaatcctcctgaaatggattaaatcattcatgacaatggctaaaatattgaagccattattttagttatgagcataaaacaatagtgtcagaaaagataataaaaattattttgagttagagatagtgattgtgattttcaaagcagaagttaagaacattattcattttactagtaatagtaggtggattgctttaggggttgaaattgggaaaccaaaaaaccycttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagctttttttttttttttttttttttttttttgtggatgcacataaattg

SEQ ID NO: 204314 - DNA, 601 bp, Human
agtaggtggattgctttaggggttgaaattgggaaaccaaaaaacctcttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagcyttttttttttttttttttttttttttttgtggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagtagtagtaataaagtcctacagtggag

SEQ ID NO: 204315 - DNA, 601 bp, Human
gggaaaccaaaaaacctcttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagctttttttttttttttttttttttttttttgkggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagtagtagtaataaagtcctacagtggaggttggggaatgatggaatattttaaggtga

SEQ ID NO: 204316 - DNA, 601 bp, Human
ttattttagataagacagttaccagctttttttttttttttttttttttttttttgtggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagyagtagtaataaagtcctacagtggaggttggggaatgatggaatattttaaggtgagagattcagtgaagaagactgaagtgactaactgcagggtctactttagaagtgtggagaatcacagaaagtgctgagatctgggatggcctattagaaacaatgtgtgaaacttggaaggtaggatagttcttattttaagaaaaaagaaatgattcgtcttacatttactctctttagacttcatttttttctgtttttgtttgttttttggtagagatgggtcttcctttcttgcccaggc

SEQ ID NO: 204317 - DNA, 601 bp, Human
gtcttcctttcttgcccaggctggtcttgaactcctggcttcaagcagtccttttgcctcagcttccgaaagtgttggaattagaggcgtgagccactgctccctgcctagacttaagacaccatccttttgtcagagatggcctcatagatagtatgtatgatcaattttgttaatagatggggcaggtgagagacagagaagttccttatccaaatttggtaggttttggccttataaatttgagtttgttcatacaactgttgccaacattttgtgcgctatttatattaacttacawcatatgaattttttctgtcttccatcaagttgattgataaggtttaaaaggatgggctaaagaaaagtacttttgtcttcagaatttccaggtttttttgttctttgattctttttcaatgaagtgaaatctaatattagactatattttcctatcacttgcttaagaagagacaatggaaaagaaacaagaatgcagtgatttttctgaattgaatgaattgttactgtgttcttgatcctgttcttgtccttcctgtcttatctatatcatctagttgtggttgggacagtcacaaaa

SEQ ID NO: 204318 - DNA, 601 bp, Human
tgatcccacctgcctcagcctcccaaaatactgggattataggcaagagccaccacacccagcctacatttatttattttagaaataatcacctcatgtactgagctgcttaattctctaaatttattttattatatacctttattagcaaaatatatttgagtgtacaccccaatatatgttgataaattttatacatgtgacaatatattgacttatatgtatgataaagcttcctacaatataaattttgaaaggagaaagtaaaaagcaattctaagcaagttgtaattttctcctrcatcccaacatatagccttatacactgttttggcatacatgaaccccgttttggagactacagctgtaaacaataccacttaaattgatactctagtaatatataaagtagccatgatcaattttggttccctgattcaagcttctagattataaagagtgtgtgtgtgtgtgtgtgtgtgtgtgtgtgtgtgtgtgtgtcttttttaaaagacagtcactcggtaagttaattgactcaacagaagttggcagaatacagaggaaaattctatcttataaaaaggaagtaaaactacgt

SEQ ID NO: 204319 - DNA, 601 bp, Human
tgacaatatattgacttatatgtatgataaagcttcctacaatataaattttgaaaggagaaagtaaaaagcaattctaagcaagttgtaattttctcctacatcccaacatatagccttatacactgttttggcatacatgaaccccgttttggagactacagctgtaaacaataccacttaaattgatactctagtaatatataaagtagccatgatcaattttggttccctgattcaagcttctagattataaagagtgtgtgtgtgtgtgtgtgtgtgtgtgtgtgtgtgtgtgtggcttttttaaaagacagtcactcggtaagttaattgactcaacagaagttggcagaatacagaggaaaattctatcttataaaaaggaagtaaaactacgttacctgaaggggaaaatccaggctttttcttttaaaacctgttttcctgtatataccttgaattccaattgtatagtggtaatgtttttggtgcaacatttgtggatgggacaaagagaatcgtattatagttttctggttaggaatcagtaaattatggaaataccagtcagaattagaagaaagtctaaagtttagaa

SEQ ID NO: 204320 - DNA, 601 bp, Human
tttgtggatgggacaaagagaatcgtattatagttttctggttaggaatcagtaaattatggaaataccagtcagaattagaagaaagtctaaagtttagaatagttgaaaagaaatgcaatttcatagagtatttcaggttattttgttaggagagagatcgttcactatttgctttcttgtaacttttgaaaaatgtttagcatgtgcttggattacctattaaataagtgtaaaaatacatgaaagaaaggcaattcttttgtaaatatgcattaagtagtaaataaaacacagtagsccgtgtgtggtggctcacagcctgtaatcccagcactttgggaggccgaggcgggcgaatcatgaggtcaggaaatcgagaccatcctgactaacttggtgaaaccccgtctctactaaaaatacacacaaaaaaattagcctggcgtggtggcagttgcctgtagtcccagctactcgggaggctgaggcaggagaatggcgtgaacccgagaggcagagcttgcagtgagctgagatcgcagcactgcttgacagagtgagactccatctcaaaacaaaacaaaacaacaaaacaaac

SEQ ID NO: 204321 - DNA, 601 bp, Human
agagggatgttttgagaattaaatgaattaacagtacctggcatacgctaagcattaatgtgtgttaaaaaaaaacacaacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaaycttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtaggtagaagtattgaaaattgttactttatttaaatgaggcagatgcttgtagaaaaacaaaactg

SEQ ID NO: 204322 - DNA, 601 bp, Human
caacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaaccttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtaggtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtca

SEQ ID NO: 204323 - DNA, 601 bp, Human
aatgaaaaatatgaaagtaaagtctttaaatcttttagttaagtgtttcaaatttttaaaaacttgcagttctttaaaccttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaayttaggaacctgtaggtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtcataatatttataaaagtaagctcatggtgggacaaattaatacatctccaagtcttacattagtatgtgtttttattctgaaaacttataattctgtacttattcaactacaaattgctaataatttatttttagaagaaaataaa

SEQ ID NO: 204324 - DNA, 601 bp, Human
aagtaaagtctttaaatcttttagttaagtgtttcaaatttttaaaaacttgcagttctttaaaccttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtakgtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtcataatatttataaaagtaagctcatggtgggacaaattaatacatctccaagtcttacattagtatgtgtttttattctgaaaacttataattctgtacttattcaactacaaattgctaataatttatttttagaagaaaataaagacaatcttttgag

SEQ ID NO: 204325 - DNA, 601 bp, Human
aggagttcgagaccaccctggccaacatgatgaaaccccatctctactaaaaatacaaaaattagccggatgtaatggcacatgcctgtaatcccagcttcttgggaggctgaggcaggagaatcgcttgaacccaggaggccaaggttgcagtgaactccagcgtgggtgacagagtaagactctgtctcaaaaaaagaaaaaaagttatttttttttcttttaaaatataccacatgtgcagtaggaggaggcccctcgtgtactctctcctgtcccattccatcaacttctctctccrgagataaccaccaccatgatgcatttagtgtttgtgtttctggtatgtggttttgtagtattactacataggcattaggttagaaatttgtataaattttgcacttataaaagtttcttttatgtaaattattatccatcaacttgtttttgagaagggcatttgagatgttacattgattcatgtagttctagttctctagttcatttattttaacattacttctatgtagtatacccttgtataaatatacactttatccattctttggtaaatattttggttgttcccaattttttg

SEQ ID NO: 204326 - DNA, 601 bp, Human
gtataaattttgcacttataaaagtttcttttatgtaaattattatccatcaacttgtttttgagaagggcatttgagatgttacattgattcatgtagttctagttctctagttcatttattttaacattacttctatgtagtatacccttgtataaatatacactttatccattctttggtaaatattttggttgttcccaattttttgttatagtgctgtagtgaatgtgtgtgtgtgtgtgtgtgtgtatgtgtgttaggcaaatgtagtttttaaagatagttttcagtgtgtggkctggatacctctgggggaccatttccctctcttcccagaccttgcaagagtccataggatgaaaattataataatacttctaagattttctttgcctttttttctctcatgctctcagcgtgatagcttacggtggagttttccagagggtatatgatgtatgatattgcgacagattgaatgcaggagcaaatacgagaacccagccatcttctatcataccagatttgcaaaaatgtaaaacaaagtcattctaaattttactaagttttgtttgttttggaaaatatagttttttta

SEQ ID NO: 204327 - DNA, 601 bp, Human
ctctgtctcggaaaaaaaagaagacataagaatggccaataagcacgtggaatagtgctcaatatttttagttatcaggatagtgaaaaaaccactgtaagacaccattaaacacacacatcattaaacacacacaagaatggctaaaataagacataccttatgttggctggaactcctatatggtcctggagggcataaagtgatataaacacttaggaaaactgtgggtatgttataaagttaagcattcacccacctatgaccaagcaatcccactcctaggtatttaagagaaatraaagtaacatttacaaaatggttgtaaacatatgcttttattcaaccaaagttattgtaaacaaaatgaaaagacaagcacaagactggaagttttttcaatgaatattaccaacaaagggttgaatatttagaagaatattaaagaatatttataaaagctttattcaaaatagctcaaactggaaactgaaatgtccatcaacaggagaatggagatatatatattgtggtatattcatataagggaatactactcatcaataaaaaagaacagtacgaattaatcttatgtttgcat

SEQ ID NO: 204328 - DNA, 601 bp, Human
ttaaaatcctgaaagtatttgggaacgtttttcttgacattgttactgcctcaaatctctgtgtagttttataaaaacttagtcattttaggatttttctagctgaaactgtatttttctctctttttctaagagggcattgttggtaaaatcctcatgaattaagaactggagactcatgttcattcacaagcaaaaatatgtttttttctaatttaatcattctattactttcatgttctaaagtgtcagttatattttgaggaattcggttagtaaatataaagaaagtctttgaagytggcactttgtaaaagcagaaggagcatcgatatttcgtcttactctgccccacctccagccgtaatccacgtgtctgagtgggttggacacctgatctctgtgcttctttgctgtataatcaaaaaggaagaagaaaagtggtctcccaagtgctggcttctcaaacagctcccgttatgtctcataagaagtgccttgaggtacatggttcataatctgtgtctccttgagaccaagaccatgaagccttggagggtacccgccaactattattctgtccttgtacctttgagcccct

SEQ ID NO: 204329 - DNA, 601 bp, Human
ttaagaactggagactcatgttcattcacaagcaaaaatatgtttttttctaatttaatcattctattactttcatgttctaaagtgtcagttatattttgaggaattcggttagtaaatataaagaaagtctttgaagttggcactttgtaaaagcagaaggagcatcgatatttcgtcttactctgccccacctccagccgtaatccacgtgtctgagtgggttggacacctgatctctgtgcttctttgctgtataatcaaaaaggaagaagaaaagtggtctcccaagtgctggctactcaaacagctcccgttatgtctcataagaagtgccttgaggtacatggttcataatctgtgtctccttgagaccaagaccatgaagccttggagggtacccgccaactattattctgtccttgtacctttgagccccttcacaggctgaatctcaacaaattcctaggcactgtgtatctagaaatacatagtatttcaagggcttacaagacagtgatgagtaaagtatctctgagtattaataattgtggtcaaggttcagtaccttttaacaaaaatgtagaaaataagtggtcct

SEQ ID NO: 204330 - DNA, 601 bp, Human
aagtttgcaagttgtgtgtgttaggttaatcagaaaaattttcaagttttgttgtttatttgcctgtttgctgttgaccttttaaaaaagttaattattccttggttcaagggtgagccttacttcactttaatttttgaagcacaggcataagagaaattcatttattctgcactaaatatttactctgtcaaaaataattatcttacatggtttcaatttacacagtttctagaatattttatttagacagttaacagattcagaaagtgtttgttgctagaaaaggtgattaatgggmggataaggatgctaaaattattcagctgaatccaagattattgtgtatatttcacttagggtatacgaacacttttctgcaaaaggctaatttaactaacacagctccagtgtagatagggtagtttgttttttatttttgtttgctcggggtgtgtgtatatgtgtgtgtgtgtgtgtgtgtgtgtgtgtgtgtgtgtgtttatgactgcagatcacagctcagggctcttgtttctttaacttggagtttccctcccaggagtatgctcagagatgcaaactgtgtgtactgctatca

SEQ ID NO: 204331 - DNA, 601 bp, Human
atttattctgcactaaatatttactctgtcaaaaataattatcttacatggtttcaatttacacagtttctagaatattttatttagacagttaacagattcagaaagtgtttgttgctagaaaaggtgattaatgggaggataaggatgctaaaattattcagctgaatccaagattattgtgtatatttcacttagggtatacgaacacttttctgcaaaaggctaatttaactaacacagctccagtgtagatagggtagtttgttttttatttttgtttgctcggggtgtgtgtatrtgtgtgtgtgtgtgtgtgtgtgtgtgtgtgtgtgtgtgtttatgactgcagatcacagctcagggctcttgtttctttaacttggagtttccctcccaggagtatgctcagagatgcaaactgtgtgtactgctatcaaccttttagtttcatagattatcttaggttttttagtcttctactggatttctctttcacctgcggtatttctaaattaggtagctacttgcagggtgtaagtctttgaagccattgtatttgaaaatacaactagacttaataagctcttcaagggcaggg

SEQ ID NO: 204332 - DNA, 601 bp, Human
tcattggctgggcgaggtggctcacgcctgtaatcccaacactttgggaggctgaggcgggcagatcacgaggtcaggagatcaaggccatcctggctaacatggtgaaaccccgtctctgctaaaaatacaaaaacaaaatgagccgggcgtggtggcgggcacctgtagtcccagctactcgggaggctgaggcaggagaatggcgtgaacccggaaggcggagcttgcagtgagccaagattgcaccactgcactccagcctgggtgacagggtgagaccgcatctcaaaaaaaaaaataataaaaaataaaaataaaaaataaatatatatatatataattgtagagatgatgtaataccacaaagaaatacacattaaaatcaaatgttgcatttattcccagaatgacaggtaataagaaatgtcagtgaaaacaacaggaaacagtttggtataaataagatgataccaagttcaggagtcacgctgtatacagcagtaagccttaaaaggagtaaaattgttatcccaataatataatatgctggaaaccatcaggagaatgaatcttgacattaattataagaaagaaaaga

SEQ ID NO: 204333 - DNA, 601 bp, Human
tgaattataattaataactcattaactgactttcctaaatcttttgaatttttggcttttgatattcatactgcatctatcaaacataaatatttcaaacctgaataatttaaacaaaacatttcccctttggatacctttttcttttgttatgaaggtgagaggaatatttatgcttaacaaatacattctttaggattatttttacacttttaagaacactatttgtgctatagtctctcgtcttcctcatgtgttcagtgctggcccacaaacgtgtcagtttttatttttgtaagtraaaggaatcagtttcactcattattttcaaacagaattcctagcatcttaagagtttatagaggcttcagggttgtataagccagcatcctacttggtacaggagtggaaggcatgtagaaagcatgactaacgaagagaagcgtagatgggcaccagaagaataggacccaattttactgattagattggatgagttccacaaaacatgatgaaaaactgtcagatgtcttctgaaatccagatatatctctgatagcatcctgacagcaccccataaccttatttttaaacagtacct

SEQ ID NO: 204334 - DNA, 601 bp, Human
ttttttaatcctaagatactgttttgaaaaagttacccttctagaacagtttaaagagttcagtgagcgcctttatctaggctccccagatgttgatattttgccacatttgcatgctctctcctctccatctttacacagacacacactcttttttattgaaacttttaggaatcttaaatacttcagcctgtatctcctaagaaaaagggcattcttctaggtaatataacactgaaggaatttaacatcgatacgatactattatctcatacagagtttagagtcagatttcctccaytgtcctatcatgtttttttctctctctcttttaaattcaagctaattcaaggattttttattgcatttaattgtcatgactcagtttttcttgcctttcataaattgactccctgaagtttttgaaatttgctttttcagagttttgaaggttattcctaaccataagacagttccctataccgcctgttatgcattcatagatggcattagcacagctgctgtttgttcagtatgccccaccgacgtccatgaaatctttgcattgacatttactattgctttcaaggactacttgaaa

SEQ ID NO: 204335 - DNA, 601 bp, Human
tgtaccataaaaataatgtattttattttcatgttactttaaaaatgatattgcttcttacttgcttatatttatcattccccccatttgtgtccttagaaacatttgttttaattgctctgcttttcttaagtacatttatatgaagagagctatttaatgtattttaaatacatttcttagaattgaaagctcttcttagaataatgaaaaaatttgtaattcagaattatattttattgactaataaataagcattcatgttatattacatagacaattaattagaagttaagtgaarttaaaattttcctgtagttaaattatttttatttttatttttatttttttgagatggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaag

SEQ ID NO: 204336 - DNA, 601 bp, Human
tagttaaattatttttatttttatttttatttttttgagatggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagytgtgagccaccgtgcctggcataatgattgttttagaagggatcttggtgttagactgtatagttggtgagactgaagtgtcttagatggaggttgtacctgcaggagagtcacaatgtgtgtctcatctataacagagattctgaggcagaggtcattataagttttgaaggtaacctgtgagtctcaaaatgttttttatgaatttgtaattccgaggctgggtatggtggctcatgcttgtaatcccagcaatttgggaggctgaggtgagacgatcccttgaggggattgtgctac

SEQ ID NO: 204337 - DNA, 601 bp, Human
tagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagctgtgagccaccgtgcctggcataatgattgttttagaagggatcttggtgttagactgtatagttggtgagactgaagtgtcttagatggaggttgtacctgcaggagagtcacaatgtgtgtctcatctataacagagattcygaggcagaggtcattataagttttgaaggtaacctgtgagtctcaaaatgttttttatgaatttgtaattccgaggctgggtatggtggctcatgcttgtaatcccagcaatttgggaggctgaggtgagacgatcccttgaggggattgtgctactacgctccagcctgggcaacagagcgagactgtctcaaaaaaaaaaaaaaaatagagtttataattcccaaagccttccctcccctctgagggaattttatcaaggaatacatttctctaataagggaagtagctcaaattttt

SEQ ID NO: 204338 - DNA, 601 bp, Human
atttgggaggctgaggtgagacgatcccttgaggggattgtgctactacgctccagcctgggcaacagagcgagactgtctcaaaaaaaaaaaaaaaatagagtttataattcccaaagccttccctcccctctgagggaattttatcaaggaatacatttctctaataagggaagtagctcaaatttttgaataaagattattttgattatgagtcttagtagtctaatttgcaaaaatagatgatggtgatgatgacaacaatactaattaaaatttatgcacggtcaactgtgtgtcragtgctgtttctcaactttgctttccctgagacgacctatgagaatcactagtgcaatatttgaagggagttttcttattatctccattttacaggtatggaaactgaggcacagtttactttttatttttaatattattaatttattccttagtactgagtcaagcctagttttttcttgttgttgttgttgttttgagacagaatcttgctctgtcacccaggctggagtgcagtggcatgatctcggctcactgcaacctccgcctcctgggttcaagtgactgtcctgcctcagcg

SEQ ID NO: 204339 - DNA, 601 bp, Human
aaaagatctacttgtctctgtttgtataacttggaatggatgagacctgccctctcagccatctataagcaataatgttagatgctctgtgatgatttggaagaaggtgaggagagggaggaatatacaagggaggtgggcatggatggagtgaagagtggaaggtgatgattgtaccaattttctgtgttttaatttgaaatcatctccaacttccatatattcagcaagagtaagtcaaaatacttttttggcctttttaatgatgaggtcatgtttctcactgtaaggttcaattatsaaaatttttccaaaatgtaatatttatgaatcaatctttttttatagttgtgattagtatatgcatatatgttacatcattaaaaaacttttattataaaattgataaatgcttatggtaaaaaagtgaagtagtacagaagagtataaaatgaaaacaaagggttgtgtctctacagtgttcccagtcccagtcctaaaaaatagccatacctaatagtttgttgtgtatttccttgggtgtttttatgcacatacatatttagttgaaattaaacttatatccaattttttgaacatt

SEQ ID NO: 204340 - DNA, 601 bp, Human
ttttcaagaataacctggacgatagaagatttttgcctcatatgttgtttagaatttatcacccatgtaagatgtgaatctactgaaacagaaacataaataaggtgcgttctgtgtttctatgtagaagagagtatttaatcctaactcatgtatttattttggggaaaagtgtcagggaggatgtggcatttgagcagagatttgagggaagagaaggatttttataggtgggaatgggtagtggaaggaataaatttccaattcagcaaaccatgtaagttaatatgatgttcagggwatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctac

SEQ ID NO: 204341 - DNA, 601 bp, Human
catttgagcagagatttgagggaagagaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctacta

SEQ ID NO: 204342 - DNA, 601 bp, Human
agaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgtgcgtgtgtctgtgtgtgtgtgtgtggcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctactaacaattcagtgttatagttgttgct

SEQ ID NO: 204343 - DNA, 601 bp, Human
gcaaatactcctagtcagtgttatctatctggacatgagttcatttcactgtcctcattaaaagatagtttggctaaatagagaattcttgggcaatagttttttctattagcacttggaatataccatctcactaccttctgacttccattgtttctgatgagcagttagtaattgttttgttgttcccctgtatgaaataaatcatttctctcttactgctttgacaattttctctggttttgagtttaacagtttgattaaaatgtgtgtgggtatggatttcattgtgtttattctrtgctgaggttcattgaacttctagaatctacataaatgtttttgtaaaatttggaaagttggccattttattgtaacatttttctttgcttctctctctgtttccattttttatggaacttctattatacttaggctagtatacttgatgtctcacagatatctacgactgtctatttttattcattctttttttccgtttttcaaattgaataatttcccttaatctgtcatcaggttcctgattctttcttttgccacttcaaatctcttgagcccacctaatgagtttttcatctca

SEQ ID NO: 204344 - DNA, 601 bp, Human
ttggtcagattataagggcaatgggacttgtgtgagtttgggggcatatccaaattttaggcagttttcaagtatactagcttttactttctgccaagctaactcatacctcctctaagtgcgctgtagccacctcgacagcctagagatatgtagagggctagggcactgcccagtttctccgtcctacccacactgccttccaggcagccacggatgcttggagaatttatcaagtgcctccgtgtctgcctcattttctgttaaatttctggttagttcactgcatccaggaccaagygtcaggctctctaagcttctacccttcctgcttgtttgtcggttttttggttttgttttgtttttgcttttcttgtattctctcaatcaagttagcctcttcctgcaaagctggtagaaccaccatgctgaccaacctggtgggtgagggattgcagccctaggcaggaatgccatgggctaccactgtcctaactcaaaatcagtagctatttttatgaataaattcttaatttgttgtatgcctttggttgatttccagagccctgatcctttttttttttttttttttttccagttt

SEQ ID NO: 204345 - DNA, 601 bp, Human
cagcttgctcttgaattgtttcttgagcaaagccaagagccctcccagagtttcttgagcaaagccaagaaccccccaattttggggttcaccagcattattaggttttcctcattttcatcaagaatatatttataaaggaagaaaagatttttttgtttgtttgtttgagacagagcctcgctctgtcacccaggctggaatgcagtggcaccatctcagctcattgcaacctctgcctccggggttcaggtgattctctggcctcagcctcctgagtagctgggattacaggcgcccrccaccatgcctagctaatttttgtatttttagtggagatggggtttcaccatgttgcccaggtgggtcttgaacttctgacctcaggtgatctgcccgcctcagcctcccaaagtgttgggattacaggtgtgagccaccatgctcagctgaaagaaatagtttttcaaaatatattactgcatagctcccttaaacattcatatctccaaaaaagagataattataaaattctctgaaatgttcatatttcaaacataagaagggattaaaacaaaaatgttttcttgctaataatcag

SEQ ID NO: 204346 - DNA, 601 bp, Human
tataggctgaggctagctgtaaaagccggaggggtgtttggtgactttgggggtagaatcttacactggagacctggcaggacccccctcagaatcaagggaccgagggggctcccaggggagagagtgtggcccttctaggtggagtggctagaaggagataatctaggatatctggtgtggcttcttggtgcctggaagtaacatgagctagacacatcctacagttgtcccttaagtcaagatcctgataaaatgccataaaagcctgcacataaggggcctctcctcatttttcctsctttttacagaataagtccaattgtaaaatagtatcataatgtaaagaaccatttttaggttgggtgcggtggctcacgcctgtaatcccatcattttgggaggccgaggtgggtggatcacctgaggtcaggagttcgagaccagcctggccaacatggtgaaaccccgtctctactaaacatacaaaaattagccaggcatggtggtgggcacctgtaatcccagctactcgggaggctgaggcaggagaatcacttgaacctgggaggtggaggttgtagtgagccgacatggcgcc

SEQ ID NO: 204347 - DNA, 601 bp, Human
tctcaaaaaaaaaaagccatttttaggccaaatttcttggtttcccaatttgtattggacccaagtggtgttgctaaactaaagaaaattagtttctttttaagcgatttaatttgactttgcttcagttgcctaaaaagcaccctagcaatgagtcctctgggatgcttcccgttgtccccctaacagggatctctgctagacagtagtacaaatgccatcaattcctgagagcctaagtacagttagggtgtgaagaaagtcaattatgaggtatgaatgggtagtgaagtgatcactstatccagcagcaagcagaatatgacaaaagaggtgttttttttaagacagagtctcgctctgtcaccaggctggagtgcagtggtgcgatcttggctcactgtagcctctgcctcctgggttcaagcaattctccggcctcagcctcctgagtagctgggactataggtgcgcgccaccatgcccagctaatttttgtattcttagtagagacggggttttaccacgttggccaggatggtctccatctcttgacctcgggatctgcctgccttggcctcccaaagtgttgggattacag

SEQ ID NO: 204348 - DNA, 601 bp, Human
ctcaaaaaaaaaaagccatttttaggccaaatttcttggtttcccaatttgtattggacccaagtggtgttgctaaactaaagaaaattagtttctttttaagcgatttaatttgactttgcttcagttgcctaaaaagcaccctagcaatgagtcctctgggatgcttcccgttgtccccctaacagggatctctgctagacagtagtacaaatgccatcaattcctgagagcctaagtacagttagggtgtgaagaaagtcaattatgaggtatgaatgggtagtgaagtgatcactcyatccagcagcaagcagaatatgacaaaagaggtgttttttttaagacagagtctcgctctgtcaccaggctggagtgcagtggtgcgatcttggctcactgtagcctctgcctcctgggttcaagcaattctccggcctcagcctcctgagtagctgggactataggtgcgcgccaccatgcccagctaatttttgtattcttagtagagacggggttttaccacgttggccaggatggtctccatctcttgacctcgggatctgcctgccttggcctcccaaagtgttgggattacagg

SEQ ID NO: 204349 - DNA, 601 bp, Human
catcatttgtaaactgttgtggtgctggtgggaatgtcttatgcaaatgaactataattcctagtcctagctggtttgggctggtctctttactacatcatagtttttgtttttgttttcattttgtttttttaagagacaggttttcactttgttgcccaggctggtgtgcagtgacatgatcttggctcactgcagccttgacctcctgggctcaagcagtcttcccacctcaggctcccaagtagctgggactacaggcaggcaccaccacactcagctaatttttttttttttttttaagagatgaggtctcactatgttgcctagactggtctcaaacacctggactcaagcagtccttccacctcagcctcctaaattgtggaactacagacatgagccactgtgcttggcctacattctgttttgatcagcagtgtcatgaaaacaagccctgttaatctcctatcttactagcaaggtgaagaaatagaaaaataagaatatcataatcatactaccgaggaatagctaccatacaaactttggtgtctatcctaccagaattttttcatggatattttctgtaggttcaaac

SEQ ID NO: 204350 - DNA, 601 bp, Human
aattaagtagaatatttgagcctatcctgttctggactcatcctcttagaaacgttctttgttgataggattcctttgataaaccgattgaatgctctgtcctcttaattgtgccatgctataaataagtcagttattaaaagaaatggttgatgttttatagactgaatgcatacttgtagagcatgttgtagaaagatactttattgaggttagttccagtgattgagtacacatacttaagtttttaactctttggaacccaagagtagaataaaaaattatttacaaaacgtatgtsggttctgacatagggtattgtttttcctttggaggcatttttgaagaaaaaaaaattacacattacaaaaaccagattaaagagtttggcatgtacagctgtgtgtgtgtgtgtgtgtgtgtgtgtgtgtgtgtgtgtgtgtgtgtttgagactaagtcttgctctgttgcccaggctggagtgcagtggcaccatctcggctcactgcaacctccgcttcctgggttcaagtgattcttgtgccttagcctcctaagtagctgggattacaggcacgcaccaccatgcccggttaattt

SEQ ID NO: 204351 - DNA, 601 bp, Human
atttatttgttacagaaatatttactgacctcctaatctttgtgccaggaattttggtgagtaagacaaaaggctctcattttcactcatcctctctgtccccatttcttggacaaattgtgtaggacattttaacattgagcaagttttcattcattcattcattcattcattcaatgtgtgtttgagtgtgtataatacaagtacattattgtgagatatttaaaaaagacatctctgccctcaaggaccttgcaagcttgtttgttcatcaaccagtcatttatttaaaaaaaaaaaagcattgagctagtaggcaatgtgccaagtcagtgctagggaaatacagagatgaacaagagcacacagtcggttcctggagggctgcgtctcagcctggagaggcaaacagcttgtaacatctttggaagcatgcagtgtggtaaatgacaataatgagctcgtcccactgtattgcgagagtgcaaaggatgagcacagaagtggagtttccagaattagttctgtgtgggtgaaaggtcaagatgtgactctccatctgactttttagttgaggctggagagaagggttggcttggaa

SEQ ID NO: 204352 - DNA, 601 bp, Human
acaagttaatcttaaccaaatatcttgcctactgcctactgcctactgcaccacctcgttgaatgtgtcaatcctgtgaacatggccagcttcatgggccctgcactcacgagggccgtgcatttggtttaatgctctgctcttgttgtcctttggaaagtcttaatttttgaagatggggcccatatatggtggtttttgtttcgttttgttttgttttgtttttgcactgggccatacaaattatgtagcattcctgcctatgaagttggccatctctggggacagaaagttagagagycaagctttagaagtagatatccttgtgttctctggagagtcgcagccaacccagttaaagtgtcccagacacattggcagggccatccctattgagtgcctcaggctatccagcctgattccctgaaacattcaatttatttaacaaagtttcctacttcccatttcctgctcaccaagcaatctttcaatagtgacttggctgcttctttggttttccagcagggagagatctagctagttgtgctggtcccatccttcattcaggaaggtagttactaaattggcaatctggtttcat

SEQ ID NO: 204353 - DNA, 601 bp, Human
gcctgcttctgcatgactggtccattcctgttacgtttctgagactgaaggctgaagtccaggaattacgcgggtaaattcaccaaagcagtcatgtgtagaatagtggttaagagcaagagctttggagtcaagacacacaatcctggataaaacgtgggtcctgtcacttactaggatgtatgtatgatcttggctttcctgtgccctagtctttcatctgtcaagtgatgacattaacacctaccttaaggttgttgtgaggttgaatgagatgatgtactttagatcagggtttctyagcctcggtactgttgacattttgggccaggtaattctttctgttcagggcggggtgttcggtgcatcatagaatgcttccagcatccctggcctgtacccagtagatgctagtggcatccctctaaccccctatagttgtgacaattaaaatgtcacagaggtggaatcacctctggttagtacttggttaagagtcactggttaagagtctcttggttaagagtcactggttcaggtgtttagagtggtgcctgggggaaagaaaatgttttatgatataataataataatgggaata

SEQ ID NO: 204354 - DNA, 601 bp, Human
cagagtccagggtatgtaatttactgaatgaatgaattttaaattgatgcccttgtcatatataaggaaaataatcatagaaaagatttaacaggcatgtaggttaacaggagacataatggaattattttgactgtttcttttcctagtctcatctccaatagcctactcctgctgtgagtcttgcagaattatttttatccagagagtatttctctttacaaaatgtatcctggtgatgaaaagtgttttcagctgtctttctcatagtgataatattatttttcttagacagtgtttytagtaaacaaaaatactgggaaagaccttctacgcctattaatttataacaacggaaagttactctgaaacaaacaaatcacggtaaaatcacatccagtgtgtcagtacagcagttaggattattttttaaatctgtgagtcttcatagtttgctcagcagctgacttcttgcaggccctaatgtttttgtaagaatttgtccactgtgatttcagcagtttttaagctatgtctttcagctcagttctactatttatttagtaaaaagtaaactaaaagatgactatgcctggaaatg

SEQ ID NO: 204355 - DNA, 601 bp, Human
atttatctaaggtcactttggtggtaatgtcgaagatggagttaaagaggggagaaaaacaggggaagcagacaagaacaaaagagtgaagcccagtaagaaaacgaggtcatgatctagggaagagaaatgggcctgaactccagggaagggggaaagggacagacagaaaagaatggtttcacaaaaaagggttaacagaacttggtacttggtgattgatttagttggggactgaaggaaagaatctaggatggctcccagtgtctagctggagtgactgcgaagttgccaccttttyctgaaatgggaaaacttgaaggaggaaggggaaactaattagtaattagcaagaagaatgatcttggctttgtgtctactatttcatttgaatttcccgaagtcattatttagcttgaaaatcttacacttcctagacttcagaaaatttttccttagagagctgtatattcatatgttgagcacagcatttataattattaatctctttgaagatattcttttcatgaatattttaatgctccactcagtaggccattttcctcctgaaatatttctaatttgaggctaactgaaataa

SEQ ID NO: 204356 - DNA, 601 bp, Human
tgataaaggactgttatccaaaatatacaaagaactcaacagtagtaaaccatcagattaaaaaattggaccaaagatgttaacagacacctcactgaagaagatatacaaatggcacacaagcatatgaaaagatgctccacatcacatgtcatcagggaaatgcaacttaaaacagcaatgagatagtactacacatctattagaatggccaaaatttgaaacactgacaacaccaaatgctggtgaacataggtggttcaacaactcattgctgatgagaatgcaaaatgcaaaatgktacagccactttagaagattgtttagtggtgtcttttacaactaaacatactcttaccatcctctccagtagtcatgctccttggtatttacccaaaggagttgaaaacttaggtccacacagaaacctgtacacaggtatttgtagcagctttattcaaaattgccaaaacttggaagcaaccaagatgttgttcagtatgtgaatggataaataaactggtacatctagacagtggacaaaatgagtgatctagttatgaaaagacatggaagacatggaagaaccttaaatgcataa

SEQ ID NO: 204357 - DNA, 601 bp, Human
cacggtctccaacacagtgtgatattctaacatttgtatctttttgaatctggcgagtgaaaagtggcatctcatttcgattttaatttggatttctcttcattttcagagaagttgagtaacttttcatgtttttaagaatcctcctttctcttttctggaagctttgcagatcttttatctttagtgttctaaaaatacattatttcatcctagtgtggggatttatggtcattgactgtgctgggcacttgagtgtgcccttttggtctgaaaacctgtgttttcagaccaaaattttctttgggtctagaaaattcatcctgtattgtttatatttcctcctttttgttttctcttttactgtctctggcactcctttcttttcatctctttattgactttttttgaggtgtttggttttaatttttttaactcttttatttacctttaaaaaaattgtaatggtggatacatgtctttacacatttgtcaaacccatagaatgtacaacaccaatagcaaaccctaatataaactatggactttgaatgataataatgtcagtatagattcagcagttgtaacaaatatgccactc

SEQ ID NO: 204358 - DNA, 601 bp, Human
gtatttcttaaaaggttctttttttataaactgtgtaaaacatgctcatggtttaaaaaattcaaaattggcggagtgtggcggctcaggcctgcaatctcagcactttgggaagccgaggccagtggatcacttgaggtcaggagttcaagaccagcctgaccaacatggtgaaaccccgtctctactaaatacaaaaaaaattagccaggtgtggtggtgcacacctgtaatcccagctacttgggaggctgagacacgagaattgcttgaacccggcaggtggaggttgcagtgagcygatactgcaccatttgcactacaacctgggcaacaagagtgaaactctgtctcaaataataataacaataaataaataaaaataggaaatgcaaatatttcacaggggcataaggtgaaaagtctttcttcctactgctttaacatcatccagtccacataagtaagtagtttgtgcatccttccaagaattgtatattattatatttgtcttaaaaaaactctataattatttaaagaagtcttgcatttatgttgaaaatctgttttcaggaaatttaagttgtgctttacctcatca

SEQ ID NO: 204359 - DNA, 601 bp, Human
agcattgtggaagtcacacattatttagtcacagttcagcatttgactctgaagtcaattcagctgataaaaaatatctcttgatcaaagagacaagacattttacatttcttttaattggaaccagttattatatacttatttaaaaatgtgatgagtcacttttttaaggtttagaggaaaagctgaattgtctcaggaaaaggaaagaactgtcagtgatttgaatacccaaagccagcaaagaaaaaacttcaaaccaggacagtccttcacccacagaagtctttgtctgcctgtmattaaagtggtgggataaatctagcatctgccatgacctgttttattcaggaaggtttacttttcaaatgtagtcattccaatggggttgccgttcagattcagattgtcagattgtcacacagtgaggaaactgcctccttgcacatcttcagaataagatcaactgttttataggttggcctctttgaatactgatagtttttagcccttgtagaaactttaatggggtataaaagacccagaatttcctagtgcacgtactacttaagttcctaagataggattaagcattttcaga

SEQ ID NO: 204360 - DNA, 601 bp, Human
tataaaagacccagaatttcctagtgcacgtactacttaagttcctaagataggattaagcattttcagagctttttagtagtctatacatgttattaaattttataaaaatgggcagtttgtgataatcctcctgacatataatagctttctaaaaaagttagaataattaacataattacttagtatttcaagcctactttttaagggtgacttgactaattataataactccttctcagggagagtcgagtagaaaataaatttttcttttaaggtcaacagactggaggtctgcctkttaaatacaggtgtgtaaagataagcaaaaaaagcccaagagaaaagtccattgcagaatagtctcactctgtaaataatatttggtcactattagccttagggctaacatgatctacgtgactatactgatgatttggaaaggtgatttttgaaatggcttcaggatgaaagtatttgaaattctggactttatatgtcacagtgggtgtgaagaggtaggttactaatggaaaattctttctgagagatataactgattatgattagtttctaaatcattaagctattttgagtcttc

SEQ ID NO: 204361 - DNA, 601 bp, Human
ataaaagacccagaatttcctagtgcacgtactacttaagttcctaagataggattaagcattttcagagctttttagtagtctatacatgttattaaattttataaaaatgggcagtttgtgataatcctcctgacatataatagctttctaaaaaagttagaataattaacataattacttagtatttcaagcctactttttaagggtgacttgactaattataataactccttctcagggagagtcgagtagaaaataaatttttcttttaaggtcaacagactggaggtctgcctgwtaaatacaggtgtgtaaagataagcaaaaaaagcccaagagaaaagtccattgcagaatagtctcactctgtaaataatatttggtcactattagccttagggctaacatgatctacgtgactatactgatgatttggaaaggtgatttttgaaatggcttcaggatgaaagtatttgaaattctggactttatatgtcacagtgggtgtgaagaggtaggttactaatggaaaattctttctgagagatataactgattatgattagtttctaaatcattaagctattttgagtcttct

SEQ ID NO: 204362 - DNA, 601 bp, Human
ggtgaccatagtcaataataaaattgtatattttaaaataaatgtaattggattttttgtaactcaaaggatagatgcttgagggggcagataccccattctctatgatgtgcatatttcatgttgcatgcctgtatcagaacatctcatgtaccccataaatatacacctactatgtacccacaaaaattaaaaataaaagtaaaaaaaaattaaaatattggcatagtaatttattaaataatatatcccaatttttactttattaaaatggtataattgtttattaatgaatgccaakctaacataattattgaggcttttattaaagaattaaaatattttatgagaaattatttaaaataaaatttttaggaaaataatgttttgagctgtatccttaaaatttttactagttcttcaaccgagttctgtatctttgagggcatgatagtataaacaggaacattttagactgtgaacatggtaaacactggaattagatcttactcaaaaacatagttgtagtttctctgtgccttcacattaaataaaaattttttttatgagtacatattatgtgtatatatttacagggtac

SEQ ID NO: 204363 - DNA, 601 bp, Human
tcatttctcagcccagaggtcttctcaatgagaccagctcttaggtttttatctttgaaggtagagacttatgagagagagtaggttgttgttaccctaaaaattcagcttcattttccatacttcatcattaaattaaatgcttttctatttcactgtcatatttgaagtattttgagagtaattaaagacaggcatatatatgtacccacaacatcttataaaatggcaagtgtcaaaacagcagtgcttctccttttgaatgtctctgttggattatcagcttacatctggtaaaaawtttgtccacatcacacagtgcgtggtagacagctgatcttttccagcagcatatttctttaaataagagtaggtcagggattggaaatctggtgccttcagagctaggcaggtaacacagagaagaaaaccaagccaggaagggactttggcagattggagaacatgtatttcattaaagaaacagctgctatcccaccatagttttattgttgccatgtggaaatatgggctatgtgatgctgatttttcaagagaagctggagattgaatttttatgaaaaattattttaaaatgctg

SEQ ID NO: 204364 - DNA, 601 bp, Human
gcgttttgcatcactgttaataacaatatcaaaactaggaaaatgacattggcataattcacagaccatattcagttttcaccagttttacatacacttagagcgtgctttaaaaatagttaaaaattactcagcagttaatagacctattatgattcagaacactcgaaaacttaatatgaagcttttatgaaaacctgatacaagaataagggaaaggagatatgctatacttagggtttattaaggatattcttacatatttgttgtcttttaagcatttataaatatacatatacamcctatattctaaaaatctaaattcaacatttatttttgtgatagaatcagatgctaaacttcttgaatttgtattaaggagttttgaaatattttaagtttctccagaatcactttgagaggcttagagaagtcagtgtctgtattattatcttccatattgtattgtttaattcagactgcatcattggagatcaaggcagagttcattaagaaacaaaagcaagaaagaacaggtatatgggtagagcaacacttttcttttagaagtccttccaaagccttgaaatggaatgtcagt

SEQ ID NO: 204365 - DNA, 601 bp, Human
ggtccaagagcgtggccctggctgcttcctttttcaagtggaacatttttatcattatgctttttcttgtattttatagtatttacctaaaatatcattgcactattgatatatatggagtcggtattgtaaatgacttagaaattctgcagatttgcaaagaatgttatttaaaaaaaaatcttctcttttctcagcaatggatgtgcaagcatttgaaaggcttctgggaccttgcatggaaattatgaaaaggaacatcgctacctatgaagaacagttagttgccctgtttggaacraacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgatt

SEQ ID NO: 204366 - DNA, 601 bp, Human
aaaacaagagcagaataatgatatccagttgatgttgtcggtgggtgctggcctctccacaatcatttatcattgtttgaaaatgaatgtcatgtcctttagtacatacttaaattaaaaagaactagcacagtgtaaaagcaaatgaaatcattttttcctcccccagaatatgccggatttaatccaaacctttaaacaaggtaacattaagcaggcaaatgaattctttgataacactaaatacgtaaataggaaagtcaaatgacgtatgcatcccttatgggtcctctgtcgggcragcatttggaccaaaacgcttattctgattttgatcccattcagagaaagatctgactctaactgagtaaaatattcgagagacgcaattcccctttcctacccccacaaactcattaatgagcatgctctaaggatagtttactaacttttttttttcccatcagggtctcagtcttggagagtaaggtgaattaggaatttccataaccaatactccccagctctttgttctttaacacacttgaaaccttctgaatctgcagtacccacaaagccttattcaaattattgtatttag

SEQ ID NO: 204367 - DNA, 601 bp, Human; identical to SEQ ID NO: 23140

SEQ ID NO: 204368 - DNA, 601 bp, Human; identical to SEQ ID NO: 23141

SEQ ID NO: 204369 - DNA, 601 bp, Human; identical to SEQ ID NO: 23142

SEQ ID NO: 204370 - DNA, 601 bp, Human; identical to SEQ ID NO: 23143

SEQ ID NO: 204371 - DNA, 601 bp, Human; identical to SEQ ID NO: 23144

SEQ ID NO: 204372 - DNA, 601 bp, Human; identical to SEQ ID NO: 23145

SEQ ID NO: 204373 - DNA, 601 bp, Human; identical to SEQ ID NO: 23146

SEQ ID NO: 204374 - DNA, 601 bp, Human; identical to SEQ ID NO: 23147

SEQ ID NO: 204375 - DNA, 601 bp, Human; identical to SEQ ID NO: 23148

SEQ ID NO: 204376 - DNA, 601 bp, Human; identical to SEQ ID NO: 23149

SEQ ID NO: 204377 - DNA, 601 bp, Human; identical to SEQ ID NO: 23150

SEQ ID NO: 204378 - DNA, 601 bp, Human; identical to SEQ ID NO: 23151

SEQ ID NO: 204379 - DNA, 601 bp, Human; identical to SEQ ID NO: 23152

SEQ ID NO: 204380 - DNA, 601 bp, Human; identical to SEQ ID NO: 23153

SEQ ID NO: 204381 - DNA, 601 bp, Human; identical to SEQ ID NO: 23154

SEQ ID NO: 204382 - DNA, 601 bp, Human; identical to SEQ ID NO: 29412

SEQ ID NO: 204383 - DNA, 601 bp, Human; identical to SEQ ID NO: 29413

SEQ ID NO: 204384 - DNA, 601 bp, Human; identical to SEQ ID NO: 29414

SEQ ID NO: 204385 - DNA, 601 bp, Human; identical to SEQ ID NO: 29415

SEQ ID NO: 204386 - DNA, 601 bp, Human; identical to SEQ ID NO: 29416

SEQ ID NO: 204387 - DNA, 601 bp, Human; identical to SEQ ID NO: 29417

SEQ ID NO: 204388 - DNA, 601 bp, Human; identical to SEQ ID NO: 29418

SEQ ID NO: 204389 - DNA, 601 bp, Human; identical to SEQ ID NO: 29419

SEQ ID NO: 204390 - DNA, 601 bp, Human; identical to SEQ ID NO: 29420

SEQ ID NO: 204391 - DNA, 601 bp, Human; identical to SEQ ID NO: 29421

SEQ ID NO: 204392 - DNA, 601 bp, Human; identical to SEQ ID NO: 29422

SEQ ID NO: 204393 - DNA, 601 bp, Human; identical to SEQ ID NO: 29423

SEQ ID NO: 204394 - DNA, 601 bp, Human; identical to SEQ ID NO: 29424

SEQ ID NO: 204395 - DNA, 601 bp, Human; identical to SEQ ID NO: 29425

SEQ ID NO: 204396 - DNA, 601 bp, Human; identical to SEQ ID NO: 29426

SEQ ID NO: 204397 - DNA, 601 bp, Human; identical to SEQ ID NO: 29427

SEQ ID NO: 204398 - DNA, 601 bp, Human; identical to SEQ ID NO: 29428

SEQ ID NO: 204399 - DNA, 601 bp, Human; identical to SEQ ID NO: 29429

SEQ ID NO: 204400 - DNA, 601 bp, Human
caacagaccccagagcagagtccagtggataaagccatccagggcttcaagccaggctgccccctccccaaccccagtgtccccaaccacagctcagctcggagaaggctgggagaaccggcagggtggtctcgagcgtccttccaggcgggattcagacactgtagctcctccagcccagccccgagaacttccccgaagccagctcttggcaatcgttgttcatatgaaaactgcccacttccctttagtgctattttggcctctgcagaaccgtggtctgtggcagcccccactcccmaccccgcccagccctgccggcccctgggggcctcagagggtccaccctccgctccctccacctcagcccacctgctttcagaacctggatgggagagtgaaagtgagagcgagacagagacacaaagggagacagagacagagagagagcacagaatttttttaaacggagtctcactctgttgtccaggctggagtgcagtggcgtgatctcggctcactgcaacctccacctcccaggttcaagcagttctcctgccttacccttccaagtagctggggactacaggcacgtgctacc

SEQ ID NO: 204401 - DNA, 601 bp, Human
ctcatcgtgggccagggttagacctttctgggtctttctggccacgtggctttctggccgcctgcaacctcccccgatgccccccatgcccttgactcctcggacacttcccctctcccctcaggccctgcccacccccagccccctgattgatcttagagccatagatggtcagggccagactcagcgtccccatgtgggaggtggaggggagctgtttggtcttctccctggaatgcctgtgcctgcctctccatctgtcacctcggttgggctcagtcccaccagcctgcatgaagcractgctgtgagcacaggctccgttcctctgttgcttctcccaggaagccacgtctgactgactctctcctgtggatttagggtatctctcctaaatcaggtcaccctgagccccagtcttcaaggagcttggaaggctgggccaggtacccattctggttcagaggaggagcccccaaacctgctttaataatgagctaatccactccattatctgtaatggcagcttccattttcaagagcacctcatggtccaagatggcagctggggtgccggccctcatctctgcattcccagcag

SEQ ID NO: 204402 - DNA, 601 bp, Human
tgggcctgggttcgggtaaatcggcagagccggttgggtggacagaaggaggctggtgctgcaggcgggggccaagaagggatagggggcgggcgggtcagcgtgggagagctgtgggcacagggcgtgggagagaggagtgggccacagggcagggaactagagggctggcttggggaggtggggggaggccaggtccttgtcaacgaggactgagcatcttctcctgaccccagaaggtacctgggatggtgatccctgcaggctctgaggccaccagaaacctggtcgctgaatgcctttgctttataggaagggcaactgagaggccgggtgtggtggctcacccctgtaatcccagcactttgggaggctaaggtgggtggatcacctgaggtcaggagttcaagaccagtgtggccaacatggtgaaaccccatctctacaaaaatacaaaaaaaaaaaaaaaaaaaaattagccaggcatggtggcacatgcctgtaatcccagctacttgggaggctgagacaggagaattgcttgaacccgggaggcggaggctgcagtgagccaagatcgcaccattgcactccagcctgg

SEQ ID NO: 204403 - DNA, 601 bp, Human
ggcctccttggccaggtgcccctgcactccccactgctcaaaggccgcccccactttgaagcctgaaggctctcggatccccaggtacctttcggtagagccttgcccctactatcctcggaggcagctctattggctcctggtgcctctgtgggactgagccaaggggggcctattctccctctctgcaggtgcccagcaggagggcataggtggcctctgcagaggggacctcagcctgtcactggccctgaagactggccccacttctggtctctgtccctctgcctccccggaagawgatgaggaatctgaggattatcagaactcagcatccatccatcagtggcgcgagtccaggaaggtcatgggtaggtggccgggagaagaggcagggtggtccacttagggcaggcttgagggactggcctggaagggcaggctgaaagtgggcttccctccagccagtccagctaaccccgcagtgatgcctgggtgcaggagcagctgcagagaccttgaaccacacaggacggcccttggcagccgcccagcctccagggtggggtcaggtcctcccgggcaggccgccccatccagc

SEQ ID NO: 204404 - DNA, 601 bp, Human
cagacaagcaaggactaatgcaatatttgggatgaacttctagctaaaagttacctgttgttgatctgtagttcagactgaactggaggtcttgcattttatctgccaaccctacaactgctgcctctggggcggtgagatggatggggtttggggaggggccagaggtgtgtgtggctgaccctggagttgggatcagggctcagtggaggccccggggatgatctggagcgagtttgaatcgagtggagctgattcactgaatcttggcttttttttttttaatttgtattgaaatgaggtctcactctgtcacccaggctggagtgcagtggcacaatctcggctcactgcagcttctccctccccggctcaagcgatccttctggctcagtctcccaagtaggtgggaccacaggcacacgccaccgtgcccggctaattttttgtatttttggtggagatggggtttcgccatgttgcccagttcctgagttcaagtgatctcaaagtgctggaattacagaagtgagccactgtacccagccagcagggtcctttttcatttttattttattctattttttgagacagtgtctca

SEQ ID NO: 204405 - DNA, 601 bp, Human
gaggctgcggcgggaggatcacttgaggccaagaatttgagaccagcctgggcaacatagcaagaccccgtctcttaaaaaaaaaattagccgggtgtggtgatgtgtgcctgtagccccagctacttgggaggctaaggcaggaggattgcttgaccccaggagttagaacaatcctgtaacccctaaaagtttttgaagcccgtttgttcatccttgtctcttgtcctgaccccagcaaccactgatctgtcttctgtatatggttttccatttgtacaatgtcacataaatggaatcytacagtccacagcctctgaatctggcttcacacagcataatgcatttacggcattgctgggtacacgggtagctggtcccttctggtccctgagtagtgttccatggtgtggatatgccacatacctctagccactctcctctctagggaaatctagcaaaccggcttggccggccctgcatcagctcgggaccccccagaagaaggtggttcctctttctcattttcacaaaggcaccatctggctggcggggggcctgtggcctgcaccccatcactacccaccccccacatcaagag

SEQ ID NO: 204406 - DNA, 601 bp, Human
caaacggaacagggctggccgagtgatgtcacatctctgggctttggtttgttcatctgttcttattattattttgagacagggtctcgttctgtcacccaggctggagtgcagtggtgcaatcatagcttgctgcagtcttgaactcctaggctcaagtgattctcccacttcagcctcctaagtagctgggcttggaggcacttgccactacacccagctaatttttttattttgtagagatgggggtctcgccatgtcgcccaggctggtcttgaactcctgtgttcaagtgatcccrcaacctcagcttcccaagtgctgggattagaggggtgagccactgcgtcctgcctgttcatctttaagtgggagaacagaacactaggtttgcagggctgtgagactcagctgagggtaatgtgagtgtgtggattaccacagagccctggagggccccaggggccaccaaggagcgggtggtggggacatgtgaggctcaagcctcctgtgcccctttgggccagagtaggaccactgttgttttttgtttttttttttttgagacagagtctcactctgtcgcccaggctggagtgca

SEQ ID NO: 204407 - DNA, 601 bp, Human
tctcccacttcagcctcctaagtagctgggcttggaggcacttgccactacacccagctaatttttttattttgtagagatgggggtctcgccatgtcgcccaggctggtcttgaactcctgtgttcaagtgatcccgcaacctcagcttcccaagtgctgggattagaggggtgagccactgcgtcctgcctgttcatctttaagtgggagaacagaacactaggtttgcagggctgtgagactcagctgagggtaatgtgagtgtgtggattaccacagagccctggagggccccaggrgccaccaaggagcgggtggtggggacatgtgaggctcaagcctcctgtgcccctttgggccagagtaggaccactgttgttttttgtttttttttttttgagacagagtctcactctgtcgcccaggctggagtgcagtggcgtgatcacggctcactacaacctccgcctcccgggttcagttgattctcctgcctcagcttctcgagtagctgggatcacaggtgcgtgccaccacacccgactaatttttgtatttttagtagaggcggagtttcaccatgttgtccaggctggttt

SEQ ID NO: 204408 - DNA, 601 bp, Human
cccttgggtgctcctgggtggctccttgcagcagacaagacccaccgcccacccacctggctccagggtggtcctggcagctccaaggggtcttgtgactctctcagtctgatgtttctctcatgtttatccaggagctggtttttcaggcatggccgcttcttgcagtgaggccaggtggggagaggcagggctttggggaaggaggtggttacctctgctcccagggcacaccctggctgccagctgtgggtgcagccctctgggcaggtgggcaaaccacatcctccctctttgatcstggtccacctccccacctgccccgggccaccagctccctgagatattctcttctcagcatatccaaaggagagatgctcttggtggccctgggtcagaggccagggctccctcacttcacagcagggtgcagtggaaccatcagggtctttgaagccagacacacctaggttcaaatcccagcctgactgctgagctgctgtgtgaccacaggcaagtgactgtacctctctgagcctcatctgaaaaaacaaggatagttttcttatatagtattgccaggttcttgggaaaatcagtg

SEQ ID NO: 204409 - DNA, 601 bp, Human
cagaagcgtagggccagagacaggacgtgacggtggggctgctgcattggctccaggtaaagatctgtatctgatggcctcactcccaggcagctcaggggttcccgtggctcctggaaaagctacagactaggcatggccaggccctgcctgtgtctctctgtgccagccacgatgagcctcatcgtttctaaaacgtactgtgctccgtctcgcttcctggaacgctgctgcctctcccctagagcgtgcgtaatgctccccggctgtgtccctgggctgatttctcgttgcaggtctyagctgggttgtcactcctctctgcaaagcttccctgacctcatctccctctccaggtcacgttaggtgcctcttgtctgtgtccccagccacagcccgcatcacaaacaagactataattgccctcgtgcttgtctgtcaccttcacagacagagtgtgacttccagtgggtcacggccccatcatcatgttgtcctccgcatccctgaccttagcaccctgcctgttgcggagtgggcatcctgtgcaaccttgtcaagtgaattagaagcaagctcggggtgggggcccatgaagggt

SEQ ID NO: 204410 - DNA, 601 bp, Human
atccatcctggatgtgcccacgcctggtcactccccacatgaggagctgatgatctttggtcaccgtttataaactttagcttctctttcctcacccaggagctccagggcaaggagtgggcctgattcacccccgttcagggactgggtcctaacaggtgtggtgaaaatgagcacttagtcagcgtcccacagcatctaaaagacgggaacaagggctgaggatgtgggtaggcccaagactggaaatagggaagcctctggaatggggactagaagatgaaagggctctggaagatgkggcatccaagtgtttaaagcaagaacggggctgggcgtggtggatcgcgcctgtaatcccagcactttgggaggctgaggagggaggatcacttgaggccaggagtttgagaccagcctggccaacatggtgaaaccccatctctactaaaaatacaaaaattagccacacatgccagtgcgcacctgtaatccccgctactcaagaggctgagtcaggagaatcacttgaacctgagagacagaggttgcagtgagctaagatcgcaccagtgcactccagcctgggcgacagtttttt

SEQ ID NO: 204411 - DNA, 601 bp, Human
aaaaaaaaaaattatagagatggggtctcactatgttgcccaggctggtctcaaactcctgggatcagaaacctggtggtcattccaggtgcctcccttgggaccccccgtcgccagctcctggtcccaaagctctgccccgtcctccatcccctgctgctgtctgcttcatgcctggctgtctctggcctgggctgtcgcagagacttggcaactcctggctccccaactccaagcatgacccgacagttcctccgccgtagcttcctgggatccccctcactgcccacgtctcaccccygccccacaccctgcagcgaggctgaccttccgaggtccttggcctcaccccaatggccacgctggtctctgcccaccacttcctgccctgccctgcacactccagccatgcagagctggatttgttccccacccacccacccactcccacagcctctggccccgctcaggcccgaccaggacacgtgggcggcccaggctggcggttgggtttcctgggcagccagtaatttggcactccttcaaacaggtctttatttattcagcatttatttctaggggaggtgggtgctgcggtggg

SEQ ID NO: 204412 - DNA, 601 bp, Human
ccatcccctgctgctgtctgcttcatgcctggctgtctctggcctgggctgtcgcagagacttggcaactcctggctccccaactccaagcatgacccgacagttcctccgccgtagcttcctgggatccccctcactgcccacgtctcacccccgccccacaccctgcagcgaggctgaccttccgaggtccttggcctcaccccaatggccacgctggtctctgcccaccacttcctgccctgccctgcacactccagccatgcagagctggatttgttccccacccacccacccactsccacagcctctggccccgctcaggcccgaccaggacacgtgggcggcccaggctggcggttgggtttcctgggcagccagtaatttggcactccttcaaacaggtctttatttattcagcatttatttctaggggaggtgggtgctgcggtggggcagggaaggcgcctcccttgtagaagagcagggcctgggcacagtgcctgtctcccctcctcacctgcaaacgccaactcccctgggagggtcccggcagctcaggtgtcacctcctccaggaagccccaccctgactgcctcac

SEQ ID NO: 204413 - DNA, 601 bp, Human
gtagagcaggcatggggcggcctggaccccgcatactgccggcggcggcggagtccctccgtgcccgccccgggggacgggagagaaatggagaaacctgagtttgggggctctctttgagtgctcctagtacctgatgcacagcccgagctgagaggagacagccccttttcctaaatcccgtcctccacgtggaggaaggacgccctaccttccagaagcctagatgaagggcagatggggcttcgcatggccaggcctcagatcggcttcccccagcccctccagggaagaggcaggmggctccctcacttccccttggaaggcagcatgaatccctgtacttcctggactgcccctttgcccccgcctggggccaactttcctgtcatggggtggagcagctgtgttggatggttggttttgctttttgttttgctctattttttatttaaaaggaaaatttttttagaaatgaggtcttgctctatcgcccaggctggagtgcagtggcgcaatcccagttcgatgcattcttgaactcctgggctcaagccatcctcccacctcagctttctgagtagctgtgacgacaggcgcg

SEQ ID NO: 204414 - DNA, 601 bp, Human
tttgcatcccgggctgcactgtgtatgcccctgaggtcatcctgtccagtgttggaatcagcctctgctgggcatcaggttgcctgcacctactccttgtttatatgtgggtgtgtgtatctgtggatgtaccaagtgaaagctttggggaaacatctttgcatgtaaatctttgcatttgggataattaactcaggattaatttatagaattataagtcctggagcgaagggtgggaacagagttaaaattgaacttcctgaaacacgtcacagcgtcaccaaatcgcttggctgggagkactgtgtgcacccagggcccttctgtggggtgggccaggatttagtgtgaaactcatggctgctaggctgggaagagctcgaccacaggtgtggggttttgtctccagtgacattcccagctggctcttgcagcccctgccctagtgacagcatggggtgagggggccagaggaggctggaggtggagccctgcctctaggcggaactgtaccatctgtagttgcagggcaggattaaaaagggacagttttgctgtttgtttgtttgtttttttctgtcatctgactgggtgtcccaat

SEQ ID NO: 204415 - DNA, 601 bp, Human
aatctttgcatttgggataattaactcaggattaatttatagaattataagtcctggagcgaagggtgggaacagagttaaaattgaacttcctgaaacacgtcacagcgtcaccaaatcgcttggctgggaggactgtgtgcacccagggcccttctgtggggtgggccaggatttagtgtgaaactcatggctgctaggctgggaagagctcgaccacaggtgtggggttttgtctccagtgacattcccagctggctcttgcagcccctgccctagtgacagcatggggtgagggggmcagaggaggctggaggtggagccctgcctctaggcggaactgtaccatctgtagttgcagggcaggattaaaaagggacagttttgctgtttgtttgtttgtttttttctgtcatctgactgggtgtcccaatacctgatgtctcctaaaactttttttttttttttttttttttgagacgggcctccttctgtatcccaggctggagtgcagtgatgcaatctcggctcactgcagcctcaacctcatgggatcaagtgatcctcctgccttagcctcccgagtagctgggacgacagg

SEQ ID NO: 204416 - DNA, 601 bp, Human
acccccttccagttactaccactctccctgacccaccacgataaccgccgttccatctcctggcttcagaatgtggcctccttttgaaccttacataaatggaattctaccatgtgacctcagattctttcatcatccttgcgagattccaccgtggtgttgcgtgtctttgtggtttgctcatacgtctgatgccttttccaatagacggggcacccaggaggagtcagtggaaacacatgtaccgtggaaacagatcaggtcttgcgctgaaattcggatacctctgaattactgcccrtcgtcaaagaaataaagtttatttccctaaaggatgttttgtggtgaataggaaagaatttgcaatcagcgtagctgttaagcccacaggagagcaagttgtattatgttgtgagcctgggttgggtgtgcagagatctggggttcagtctgacgcctctgggccgtggtttccctagatggacatgcaggtggttagatgaggggcccatctagctcagtgctgtgatgctaagcatatacttctcagtgctaagaggttgttttccaaagtgtttgaagtttgctcttaagatcttat

SEQ ID NO: 204417 - DNA, 601 bp, Human
gcagttccagctacttgcgaggctgagggaaagaatcgcttgagcccaggaatttgaggctgcaatgagctatgattgcagcactgcactccaggctgggtggcagaacaagactgtctctacaaaaaaaatttttaaaaatcaggcatggcagcatgcacctgtaaccccagctacttgggaggctgaggcaggcggatggctggagtccaggaatttgaggctgcagtgagccatgatcgtgccactgcattccagcctgggtgacagagcgagactccatctttacaaaacatttttwaaaaaattagcagggagctactcgggaggctgaggccggcagatggcttgagtccaggagtttgagggtgcagtgagccataatcacgccattgcattccagcctaggtggcagagcaagactctgtctctttaaaaaaaaaaaaatcttatttaccaacttggctcatttctaagtggagcaaaaatgcagtgtctcacttctgctctgcctgaattacctccaggccagatttcttggtggaaggaaggagccgtgtagatacagccagagtctcccaggtgcaaagaccctctgaga

SEQ ID NO: 204418 - DNA, 601 bp, Human
ggcatggcagcatgcacctgtaaccccagctacttgggaggctgaggcaggcggatggctggagtccaggaatttgaggctgcagtgagccatgatcgtgccactgcattccagcctgggtgacagagcgagactccatctttacaaaacatttttaaaaaaattagcagggagctactcgggaggctgaggccggcagatggcttgagtccaggagtttgagggtgcagtgagccataatcacgccattgcattccagcctaggtggcagagcaagactctgtctctttaaaaaaaaaamaatcttatttaccaacttggctcatttctaagtggagcaaaaatgcagtgtctcacttctgctctgcctgaattacctccaggccagatttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaa

SEQ ID NO: 204419 - DNA, 601 bp, Human
ttggctcatttctaagtggagcaaaaatgcagtgtctcacttctgctctgcctgaattacctccaggccagatttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaattctctgtcagcgtaayggcaatgaacctggacttgggtcttcaggaaccaaagccatggagtcaaggatttggagagatggtatattcatcaccgggcctaacatgatggtctttttttatttttaaattgagacagggtctcactctgtcacccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctc

SEQ ID NO: 204420 - DNA, 601 bp, Human
atttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaattctctgtcagcgtaacggcaatgaacctggacttgggtcttcaggaaccaaagccatggagtcaaggatttggagagatggtatatkcatcaccgggcctaacatgatggtctttttttatttttaaattgagacagggtctcactctgtcacccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctcactctttcacccacccaggctggagcgaagtggtgcgatcttggcttactgcaacctccaccctccgggtt

SEQ ID NO: 204421 - DNA, 601 bp, Human
acccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctcactctttcacccacccaggctggagcgaagtggtgcgatcttggcttactgcaacctccaccctccgggttcaagcaattctcctgcctcagcctcccgagtagctgtgattacaggcacctgccaccacagccarctaatttttgtatttttagtagagacgagatttcaccatgttggccaggctggtctcaaactcctgacgtcaggtgatccacccgcctcagcctcccaaatgttaggattacagtcatgagccactgcacccagcctgtctttcctttttaaggctcagtaatattccattgtatggatagactgtggttttttatccattcatcatcggacgctgggacggtttctgccttttggctattgtgaatactgatcctatgaacatggctgtacagatgtgtctttgagactattactgttt

SEQ ID NO: 204422 - DNA, 601 bp, Human
ttcaagcagttctcctgcctcagcctcctgagtagctgggattataggtgcccaacaccacgcccagctaatttttgtatttttagtagagatgtggtttcaccatgttggccaggctggtctcgaactcttgacctcaagtgatccgcccacaccgccgtggagtctatttctgttaggaatgtgtttgttgcaagcaacctgagaaacagaggcttaggagagaggggtgtctcgtgtaacaggaggcatgggtgggtggtccagccgcaggcagctgctcaggcacatctgaggggcytgcgccatctctctctctctcctctggctgagggctttggtcatcctggcctaaagtggatgtcagccaccaggcagggcatagggagtaagggattgagccccccattgcctgcttccagggaaactctgctcttttgtttgggaatgcctcactggttagactgtgtcttgtggtcatctctggctgcaagagagtataggaatgggaggattttgtgttgtggcccctacagaagaggagagcaagggagaagttggttatatggggattgaggtaccagccacacagcatctgtct

SEQ ID NO: 204423 - DNA, 601 bp, Human
tgggtgactttacaactggtaaagactgacttaagtaggatgtttttagctgcaaatgaaagaaacctctggctgggcacggtggctcacgcctgtaatcccatcactttgggaggccaaggcaggaggattgcttgagaccaggagttcagaaccagcctgggcaacatagtgagaccctgtctctaacaagattttttaagtgagccaggtgtggtggcaggcgcccgtagtcccagctacttgggaggctgaggctggaggattgcttgagtctaggagagatcaagatcgaggctgyagttagctatgattgcatcactgcactccagcctgggtgacagaagaaaaaaagagagagagagagaagaaaagaaactctagtcctgggggggtaaaaaaggaaagaagaaaagaaacctctactaagagtgccttaagaaatatggacttttgcctgggcgcggtggttcattcctgtaatcccagcactttgggaggccaaggtggcggatcacctgaggtcaggagttcaagaccagcctggccaacataacaaaaccccgtctctactaacaatacaaaaattagccgggtgtgg

SEQ ID NO: 204424 - DNA, 601 bp, Human
aggagttcaagaccagcctggccaacataacaaaaccccgtctctactaacaatacaaaaattagccgggtgtggtggtgggttcctgtaatcccagctactcaggaggctgaggcaggagaatcatttgaacccaggaggcagaagttgcagtgagccaagatcgtgccactgcactccagcctgggcaacagggtaagactccatctcaaaaagaaaaaaaaagacttttactgtttcacccaaagcttagagatggcagatctggggtcatacaggaccaagttcttccacgagttcmccctgccatcctcagataccctcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctcccgggttcaagcgattctcctgcctcagcctcccaagtagctgggattacaggcatgtaccaccacacctggctaatttttgtatttttagtagagacg

SEQ ID NO: 204425 - DNA, 601 bp, Human
ccatctcaaaaagaaaaaaaaagacttttactgtttcacccaaagcttagagatggcagatctggggtcatacaggaccaagttcttccacgagttcaccctgccatcctcagataccctcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctccygggttcaagcgattctcctgcctcagcctcccaagtagctgggattacaggcatgtaccaccacacctggctaatttttgtatttttagtagagacggggtttcgccatgttggccaggctggtctcaaactcctgacctcaggtgatctgcccaccttggcctcccaaagtgctgagatgacaggtgtgagccaccactcctggcctggtttcagttcctttctaagggcaaggacagctctcctagaagtccctcatgtctcagtggccagaattgggttctggcctctccttacacc

SEQ ID NO: 204426 - DNA, 601 bp, Human
tcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctcccgggttcaagcgattctcctgcctcagcctcccaagtagctgggattacaggcatgtaccaccacacctggctaatttttgtatttttagtagagacggggtttcgccatgttggccagsctggtctcaaactcctgacctcaggtgatctgcccaccttggcctcccaaagtgctgagatgacaggtgtgagccaccactcctggcctggtttcagttcctttctaagggcaaggacagctctcctagaagtccctcatgtctcagtggccagaattgggttctggcctctccttacacctgtcccagctaggggaaaaggagtgccttgctctgagccttggagaatcaccaaagttcctcccagggactgggagggcccagctgccccaagcactggttgttgggacaacccagcaa

SEQ ID NO: 204427 - DNA, 601 bp, Human
acttctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaataaaacatttaaataaaacataggtaacccctttccccattgtcaagctctgtgcctgcgcgagcttctctgcttgtccttctttcgtggtcctgtagttcttttttttttttttaaataagatggactctcactctttcacccaggctggagtgcagtggcaagatctcagctcactgcaacctccaactcccaggttctagcaattctcctgcctcggcctccctagtagctgggactataggcgtgtaccaccacccccagctaattttttgtatttttagtagagatggggtttcaccatgttggccaggctggtctcaaactcctgacctcaagtgatcctcccacctctgcctcccaaagtgctgggattacaggcatgagccatcgcaccca

SEQ ID NO: 204428 - DNA, 601 bp, Human
tctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaataaaacatttaaataaaacataggtaacccctttccccattgtcaagctctgtgcctgcgcgagcttctctgcttgtccttctttcgtggtcctgtagttcttttttttttttttaaataagatggactctcactctttcacccaggctggagtgcagtggcaagatctcagctcactgcaacctccaactcccaggttctagcaattctcctgcctcggcctccctagtagctgggactataggcgtgtaccaccacccccagctaattttttgtatttttagtagagatggggtttcaccatgttggccaggctggtctcaaactcctgacctcaagtgatcctcccacctctgcctcccaaagtgctgggattacaggcatgagccatcgcacccagcc

SEQ ID NO: 204429 - DNA, 601 bp, Human
gcagcctcttggtaggtgttgagtgaatgagtaggggtggtgaggggaggccacggaaggcacccaggctgtgttcctcccactcccagccttgccacgacctaccaggtctccagctcctgctgagctcttgcagggtggcccctccccacttacagctcactgccttggactaggtcccagccaatggcccggcggaggtgtcctcactgttcttacccagtatgacctaggcgggagccaataagcacagggaatgagtatcaccctgagggttcaaaagtgtgcaaggaagggaggragggaaggaaggaaggaaggaagagaagggagtgggggagggagagagagaaggaaggaaggaaagaaggaaggaaggaagggagcaatgaatgaatgcatacatcaaggaatgaatgaatgcatatacacaaaggaatgaatgcacacaccaaggaatggatgaatgaatgcacacactaaagaataaatgaatgcacacaaaggaattaatgaatgtacacaaaggaatgcatgcacacaccaaggaatgaatgaatgcacacaccaagaaatgaatgaatgaatgcacacatgaatg

SEQ ID NO: 204430 - DNA, 601 bp, Human
agtgaatgagtaggggtggtgaggggaggccacggaaggcacccaggctgtgttcctcccactcccagccttgccacgacctaccaggtctccagctcctgctgagctcttgcagggtggcccctccccacttacagctcactgccttggactaggtcccagccaatggcccggcggaggtgtcctcactgttcttacccagtatgacctaggcgggagccaataagcacagggaatgagtatcaccctgagggttcaaaagtgtgcaaggaagggaggaagggaaggaaggaaggaaggragagaagggagtgggggagggagagagagaaggaaggaaggaaagaaggaaggaaggaagggagcaatgaatgaatgcatacatcaaggaatgaatgaatgcatatacacaaaggaatgaatgcacacaccaaggaatggatgaatgaatgcacacactaaagaataaatgaatgcacacaaaggaattaatgaatgtacacaaaggaatgcatgcacacaccaaggaatgaatgaatgcacacaccaagaaatgaatgaatgaatgcacacatgaatgaatgcatacacacaaaggaat

SEQ ID NO: 204431 - DNA, 601 bp, Human
caaggaatgaatgagtgttcacaccaaggaatgagtgagtgaatgaatgcacacgaaagaaagaatgaatgtgcacaccaagtaattagtgaatgaatgaatgcacacaaaggaatgaatgagtgaatgtacacaccaaggaattagtcaatgaatgcacacacacaggaatgagtgaatgaatacacacaaaggaatgaatgtacacatcaaggaattagtgaatgaatgcacacacagaggaatgagtgaatgaacctgccacttgtggagagtgaaaaaagcctgagagatccccagmtgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctccccagatgtaacatggattagaagaaccacctcatggtgcttttctgaaaatttggtaggcctaacgtggtggctctcgcctgtaatcctagcactttgggagggaggccaaggtgggtg

SEQ ID NO: 204432 - DNA, 601 bp, Human
attagtgaatgaatgcacacacagaggaatgagtgaatgaacctgccacttgtggagagtgaaaaaagcctgagagatccccagatgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctccccagatgtaacatggattagaagaaccacctcatrgtgcttttctgaaaatttggtaggcctaacgtggtggctctcgcctgtaatcctagcactttgggagggaggccaaggtgggtggatcgcttgggctcgggagtttgagaccagcctgggaaacatagtgagaccctatctgttttgttaaaaaaaaaaaaaaagaaaaaaaatttggtggggtgatgggtgtgccagttggagagctgtgacatttgtttttttggttcaaccccaagccagtgcagacaagtgaccctccccagccagcgggccaggcctctcagtgtcaccctggct

SEQ ID NO: 204433 - DNA, 601 bp, Human; identical to SEQ ID NO: 33089

SEQ ID NO: 204434 - DNA, 601 bp, Human; identical to SEQ ID NO: 33090

SEQ ID NO: 204435 - DNA, 601 bp, Human; identical to SEQ ID NO: 33091

SEQ ID NO: 204436 - DNA, 601 bp, Human; identical to SEQ ID NO: 33092

SEQ ID NO: 204437 - DNA, 601 bp, Human; identical to SEQ ID NO: 33093

SEQ ID NO: 204438 - DNA, 601 bp, Human; identical to SEQ ID NO: 33094

SEQ ID NO: 204439 - DNA, 601 bp, Human; identical to SEQ ID NO: 33095

SEQ ID NO: 204440 - DNA, 601 bp, Human; identical to SEQ ID NO: 33096

SEQ ID NO: 204441 - DNA, 601 bp, Human; identical to SEQ ID NO: 33097

SEQ ID NO: 204442 - DNA, 601 bp, Human; identical to SEQ ID NO: 33098

SEQ ID NO: 204443 - DNA, 601 bp, Human; identical to SEQ ID NO: 33099

SEQ ID NO: 204444 - DNA, 601 bp, Human; identical to SEQ ID NO: 33100

SEQ ID NO: 204445 - DNA, 601 bp, Human; identical to SEQ ID NO: 33101

SEQ ID NO: 204446 - DNA, 601 bp, Human; identical to SEQ ID NO: 33102

SEQ ID NO: 204447 - DNA, 601 bp, Human; identical to SEQ ID NO: 33103

SEQ ID NO: 204448 - DNA, 601 bp, Human; identical to SEQ ID NO: 33104

SEQ ID NO: 204449 - DNA, 601 bp, Human; identical to SEQ ID NO: 33105

SEQ ID NO: 204450 - DNA, 601 bp, Human; identical to SEQ ID NO: 33106

SEQ ID NO: 204451 - DNA, 601 bp, Human; identical to SEQ ID NO: 33107

SEQ ID NO: 204452 - DNA, 601 bp, Human; identical to SEQ ID NO: 33108

SEQ ID NO: 204453 - DNA, 601 bp, Human; identical to SEQ ID NO: 33109

SEQ ID NO: 204454 - DNA, 601 bp, Human; identical to SEQ ID NO: 33110

SEQ ID NO: 204455 - DNA, 601 bp, Human; identical to SEQ ID NO: 33111

SEQ ID NO: 204456 - DNA, 601 bp, Human; identical to SEQ ID NO: 33112

SEQ ID NO: 204457 - DNA, 601 bp, Human
tctggttgacctcagtgaataggcgaggttggaggtgagtgggttcctaaccgcagaaggaggggtgtctgcatggggaccacaagcatgttggtaagatgtgggtggcgcctaccctgccttaaacagtgcagtgcctctcctgaccctttttaaaaaaatattttatatatataataaaatatatacataataaaaaatatatataataaaaatattatatataattaaaaatatttatataattaaaatattatatataattaaaaatattatatatataataaaaaatattatatakagagagagagagacagagacagaccaagtctcactttgttgcccaggctggaatgcaatggcactatctctgctcactgcaaactccacctcccaggttcaagctattctgcctcagcctaccaagtagctgggattataggtgggcaccaccatgcccggctaatttttgtgtttttagtagagctgggtttcaccatattggctaggctggtctcaaactcctggcctcaagtgatcctcctgcctcagcctcccaaagtgctgggattacaggcatgagccaccacacccgacctcc

SEQ ID NO: 204458 - DNA, 601 bp, Human
cttcatctggaggcaggtgtcccagggcaggtggaggggtggcagatagttgcagagaggcgggtggctggggacagtgcccaggagtcagccttcagggtcttaggcagcatgtgggccatgggaaagtgccgcctcattcaagtccctgtacccgcctgactagccatgggaatctgagccttcacttccttaccgccaagatggacaagcacacctgcctcaccatgtgatctgaatatgggaaaagatgggcagtgctaggttagctgggaggactattttccgccaattgccctcttttttttttttttttttttttttttttttgagatggaatttagctcttgttgcccaggctagagtgcaatggtgtgatcctggttcactgtaacctccgcctcccaggttcaaatgattctcctgcctcagcctcctgagtagctgagattataggcgtgtgccacagcatccagctaaatttttgtatttgtaggcaccctaacacaatgaaagtccaggctggttgaccaggctggtctcgaactcctggccagcctcaagtgatccgcccatcttgacctcccaaagtgctgggatt

SEQ ID NO: 204459 - DNA, 601 bp, Human
ggccgaagcaggaggatggcttgagcccaggaggtggaggttgcagtgagctgagattgtgcaactgcactccagcctgggtgacagagcatgacgccatctggaaaaaataaaaataaaaagaatggctctgagatttttttaggtcacttattgaaggttcccatggaagcctttcctaacagaaccaccccgagaaggtaaaaattctgaaagagattgtgcttttttgtttttgttttgttttgtttttttgttttaagatggagtttctcttcttgttgcccaggctggagtgcartggcacaatcttggctcactgcaacctccacctcccgagttcaagcgattcgcctgcctcagcctcctgagtagctggaattacaggtgtgcaccatgacactcggctaatttttgtattttgagtagagacggggtttcaccatgttggccaggctgatctcaaacttctgacctcaggtgatcagcccgcctcagcctcccagagtgttgggattacaggcgtgagccaccgcacctggctgagattgtgcttttttgaagatgaatcagtcattaaattgcaagagccccactgcac

SEQ ID NO: 204460 - DNA, 601 bp, Human
tgtgcaccatgacactcggctaatttttgtattttgagtagagacggggtttcaccatgttggccaggctgatctcaaacttctgacctcaggtgatcagcccgcctcagcctcccagagtgttgggattacaggcgtgagccaccgcacctggctgagattgtgcttttttgaagatgaatcagtcattaaattgcaagagccccactgcaccctagagctgtgagcctccccagtgtagggtgagagtacagccactcctggactggttttgttctgggtcaaaagagatgactcaggmcagacgtggtggcttatacctataatcccagcattttgggaggccaagatgggaaaatcacttgagcccaggagtttgagaccagcctgggtaacatagcaagatcccatcctgcaaagacatttttttaaattagccagacatggtggggacgaacgactgtattcccagctactcgggaggctgaggcgggaggatccctcgagcctaggagttggaggctgcagggagccataattccagtgtgtgtgacagagcgaggtcttgtctctaaaaaagagagagagagagagataagcc

SEQ ID NO: 204461 - DNA, 601 bp, Human
gcgtggtggctcacgcctataatcccagcactttgggaggcccaggcgggcagatcacaaggtcaggagatcaagaccatcctggctaacacagtgaaaccccgtctctactaaaaatacaaaaaattagctgggcgtgatggcgggcacctgtagtcccagctacttgggaggctgagtcaggagaatggcgtgaacccgggaggcggaacttgcagtgagccgagattgtgccactgcactccagcctgtgcgacagagcgagactctgtctcaaaaaaaaagaagaagaagaagaaaragaaagaaacaggatgggtggaagagggttgctgaatgctcatgcaagctcctgtctgcctgctccttctctcagggagggacaggggagggtgatgagtcagtggactaaatgtccccatggggatgaaggacagttggggtcaggtttctagagggagggctggaaggagggaaggagatggccagagaaggatgtgggacacagaggtgccgccatggatcaccaagaggttcaggactggccagagggaggagaagaggtcaaggtacgtgtggggcacttggatgacgcatctgt

SEQ ID NO: 204462 - DNA, 601 bp, Human
aggcttgcctacctgggcctcagtttccctacttgtaaaatgagaagaattgcccacgccacgtctgcctcccctggggccaccctggagtgcatgaccaggtgagaaggagggatgggctgtcatgagtgggaggtggtgaggcagagagactggccaggatggagcggggacagcctgggaggcctggctttgcagcatggacagggcccttcaggcctggccctggtaagctcttctgctgacgtccccatagcggaggaacccgtacagccccactggtcggggccaagctcttggygggctccagttttatctaggacatccccacatcgtctcctctgtaaacgttccactttcatctcagtttaaggaactatgtcaaattacatgctgctagctgggcacagtggctcacgcctgtaatcccagcactttgggaggccaaggcaggagggtcacttgcatccaggagttcgaaaccagcctgggaaacataaagagatcctgtctcgacaaaaaataaaaaattagccaggcatggtggcgtgtgcctatagtcccagctactcaggaggctgaggtgggaggatcccttgac

SEQ ID NO: 204463 - DNA, 601 bp, Human
ccggcctatgctggacttttaatcaacactgattaaaaaaaaaaaaaaacccggctgagtgcagtggttcacgtctgtaatcccagcacttcgggaggctgaggtgggcggatcacctaaggtcaggagtttgagaccagcctggctaacatggtgaaactccgtttctactaaaaatacaaaaaattagcccagcatcatgacacacacctataatcccagctacttgggaggctgaggcaggagaatcgcttgaacccgggaggtggaagttgcagtgagccgagattgcgccattgcrctccagcttgggcaacaagagcgaaactccgtctcaaaatacaaaaaaacaaaaaaacccagcctcacggagcctacatggtggggcggggggataaacagaaaatctgcaaagcgtaaaccatgggagcaattgtatttatttttaggagattgcaacattatttaggtgatgaccagaaggaggccttagttttaaaggcctgaaggggcagcagggaacagcattgcaggcagagagaacagcagctgcaaagcccctgaggtcacctgccaaggtatcagaggaaggtcaggggaa

SEQ ID NO: 204464 - DNA, 601 bp, Human
gcactgtggcaggccacgacgggaggatcccttgagctcaggagtttgagaccagcctgggcaacatggcaagaccccatctctactaaaaatacaaaaaaattagccaggcatggtggcatgcttgctattcaagaggctgaggcgggaggatcgcttcagcccaggaggcagaggttgcagtgagctgagatcatgccactgcactccagcctgggcaacagagcgagatcctgtctcaaaaaaaaaaaaaaagcagaggaggagaagcatagatccgttaaaaagtttaaggcccagsctggtgactcgcccctgtaatcccaacactttgggaggctgaggcggaagaattgcttgaagccaggagtttgagatcaacctgggcaacatagcaagatcctgtctctacaaaaatgttaaaattagccagacgtggtggtatgcacctgtaggcccatgtactcaggagactgcggcaggaggatgaggtcaaggctgcagtgagctaggatcgcactactgcatgggtgacaaaatgagactacatctctaaaaaaaaattttttttgaaaaggaagaggaagaaggccaggcgcag

SEQ ID NO: 204465 - DNA, 601 bp, Human
gtcagtctgagctgaagtcctctaactaggcggggagagtcagggctggccagggctcttgcactttgccccgagagagagccgtggagccagcccaggcaccacccgagccagttggtttaaaattgtgtacatagcatggctgtgattcagtgagcttggttgtcttttttttttcccccttggcaaatttcagttactccttgggctaacagacagcagactggtaaagataagatgagagttgcccagccagcgttaaagagagagaggagaccgaagaacagaatgagcaggaggsgggcaggaaaaatgtcaagggaaggcctgtccaccaaaggtgtcactgtccaggggcagtgggcaggaggtcgctgctgcggggatgggttctttcagcaggactttctgcacagcactgggggcagaaacatgaaggtgaaaccctacacacactgagtcctaactatgacatttccaaacagagaacactctgaaatgtttgcaactgtgggtgtctttacagccagcctgggttcaggggagctcaggcaggtcctcccgagaataggtttgctgacttggtgttccggacggtaaa

SEQ ID NO: 204466 - DNA, 601 bp, Human
tgactgagctagagaatcccacagacaaggtatattgtgggccttgcacagtgtctgcacgtagtatgtgccaagcttgttttttattttttaatttttgtttggttgtttgtttgaaacaggatctagctcagtcacccaggctggagtgcagtggggcaatcatggcttactgcaacattgaccttccaggctcaagcaatcctcccacctcagcctcccaagtatctgggattacaggcacacaccaccatgcccagctaatttttctttttttttctttttttttttttttttttgkggagacagggtcttgccatgttgcccaggctggttgcaaactcgtggcctcagtctcccaaattgctgggattacaggcgtgagccactacatccggccagttcttggtgttattgacaaaggcatttagccccactccacccctcccacactccagaggtggtcaggacgcctccccaaactgccagccccctcagccagcccggccccactttcctgacatgcacactcccaccacttctggtccaccgcctgggacctgtgccccatatagaattgccatagtatcctatcgactgc

SEQ ID NO: 204467 - DNA, 601 bp, Human
tgtgtctttggctgcagtgtctaggaaagcatctgcacacagtgatgtgtgtgatccaggccatcctttctctgttctgtgcatgcatggccatgcctgctgagaatcctgccaccaaagattcctcagtggcatggggacagatggaatgtgctgttgcttccctgcaggctctaggagctggtccttgggcccaggactccatcactgttgtctgcatggatttggacaagggtggccttgattcttcccacatcctagtcctgaaaggaaggcccgtgttgggtcacaggagaagacragggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagatgtgcagagattgctgagtgtgggtgtggacggaccaggccagggacctgcagggtttgggaggacctgaggtggtgggtgttggagccctgggaaaaggaggaaccaggccaagcaggtgccca

SEQ ID NO: 204468 - DNA, 601 bp, Human
aggagctggtccttgggcccaggactccatcactgttgtctgcatggatttggacaagggtggccttgattcttcccacatcctagtcctgaaaggaaggcccgtgttgggtcacaggagaagacgagggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagrtgtgcagagattgctgagtgtgggtgtggacggaccaggccagggacctgcagggtttgggaggacctgaggtggtgggtgttggagccctgggaaaaggaggaaccaggccaagcaggtgcccagcctctgtcctgtgggaagctccctgctctttggggcaacccccacatggggaacagggcctccattctggcagcttgcgcacgggaggccaagccacccagacggggtcagcagactctaagcagcacagagcaccacgccaggagatgcagttcccaaggcagcctcctaaac

SEQ ID NO: 204469 - DNA, 601 bp, Human
gcatggatttggacaagggtggccttgattcttcccacatcctagtcctgaaaggaaggcccgtgttgggtcacaggagaagacgagggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagatgtgcagagattgctgagtgtgggtgtggacggaccaggcsagggacctgcagggtttgggaggacctgaggtggtgggtgttggagccctgggaaaaggaggaaccaggccaagcaggtgcccagcctctgtcctgtgggaagctccctgctctttggggcaacccccacatggggaacagggcctccattctggcagcttgcgcacgggaggccaagccacccagacggggtcagcagactctaagcagcacagagcaccacgccaggagatgcagttcccaaggcagcctcctaaacagaagtgagctcttcccagagttttcaagattaaaagagcc

SEQ ID NO: 204470 - DNA, 601 bp, Human
aacaaaaagaaaaaaaaacaggagtcattttgctccaaagacccatcagtctgctctgccctgaatcatccggccctggctccctgcctgcgtctagctccaccccacaacatctcacccttaccgaacccgcctgccccaagaggcccagcccatgtgaccccacgcttctcagagaggagatttcctgttggacatgcaaaccacccttcctgcaatcccagccccgtcctcaaccctggcacaagcccacaggctgctgcagagctctgccccagaccccatctccagcccaaccccyactcagccttacagcccagctcaggccccatctccagggctaactgactccagcagctcctctaggctacagggaggggagagcagagcacaccagggctcaagcagcagataggccgtgacggttacctgggcagtgagcagggagaatgcacggcccccacactcccagacacggtctgtttcccattcacagaccttggtcagcgagcggtcaggggatttccaacagcccagcacagtgacaccggcccctgtgcatggaccccactaggcccatcagtcatctcccctgtaccac

SEQ ID NO: 204471 - DNA, 601 bp, Human
aaagaaaaaaaaacaggagtcattttgctccaaagacccatcagtctgctctgccctgaatcatccggccctggctccctgcctgcgtctagctccaccccacaacatctcacccttaccgaacccgcctgccccaagaggcccagcccatgtgaccccacgcttctcagagaggagatttcctgttggacatgcaaaccacccttcctgcaatcccagccccgtcctcaaccctggcacaagcccacaggctgctgcagagctctgccccagaccccatctccagcccaacccccactcwgccttacagcccagctcaggccccatctccagggctaactgactccagcagctcctctaggctacagggaggggagagcagagcacaccagggctcaagcagcagataggccgtgacggttacctgggcagtgagcagggagaatgcacggcccccacactcccagacacggtctgtttcccattcacagaccttggtcagcgagcggtcaggggatttccaacagcccagcacagtgacaccggcccctgtgcatggaccccactaggcccatcagtcatctcccctgtaccaccccaa

SEQ ID NO: 204472 - DNA, 601 bp, Human; identical to SEQ ID NO: 33113

SEQ ID NO: 204473 - DNA, 601 bp, Human; identical to SEQ ID NO: 33114

SEQ ID NO: 204474 - DNA, 601 bp, Human; identical to SEQ ID NO: 204404

SEQ ID NO: 204475 - DNA, 601 bp, Human; identical to SEQ ID NO: 204405

SEQ ID NO: 204476 - DNA, 601 bp, Human; identical to SEQ ID NO: 204406

SEQ ID NO: 204477 - DNA, 601 bp, Human; identical to SEQ ID NO: 204407

SEQ ID NO: 204478 - DNA, 601 bp, Human; identical to SEQ ID NO: 204408

SEQ ID NO: 204479 - DNA, 601 bp, Human; identical to SEQ ID NO: 204409

SEQ ID NO: 204480 - DNA, 601 bp, Human; identical to SEQ ID NO: 204410

SEQ ID NO: 204481 - DNA, 601 bp, Human; identical to SEQ ID NO: 204411

SEQ ID NO: 204482 - DNA, 601 bp, Human; identical to SEQ ID NO: 204412

SEQ ID NO: 204483 - DNA, 601 bp, Human; identical to SEQ ID NO: 204413

SEQ ID NO: 204484 - DNA, 601 bp, Human; identical to SEQ ID NO: 204414

SEQ ID NO: 204485 - DNA, 601 bp, Human; identical to SEQ ID NO: 204415

SEQ ID NO: 204486 - DNA, 601 bp, Human; identical to SEQ ID NO: 204416

SEQ ID NO: 204487 - DNA, 601 bp, Human; identical to SEQ ID NO: 204417

SEQ ID NO: 204488 - DNA, 601 bp, Human; identical to SEQ ID NO: 204418

SEQ ID NO: 204489 - DNA, 601 bp, Human; identical to SEQ ID NO: 204419

SEQ ID NO: 204490 - DNA, 601 bp, Human; identical to SEQ ID NO: 204420

SEQ ID NO: 204491 - DNA, 601 bp, Human; identical to SEQ ID NO: 204421

SEQ ID NO: 204492 - DNA, 601 bp, Human; identical to SEQ ID NO: 204422

SEQ ID NO: 204493 - DNA, 601 bp, Human; identical to SEQ ID NO: 204423

SEQ ID NO: 204494 - DNA, 601 bp, Human; identical to SEQ ID NO: 204424

SEQ ID NO: 204495 - DNA, 601 bp, Human; identical to SEQ ID NO: 204425

SEQ ID NO: 204496 - DNA, 601 bp, Human; identical to SEQ ID NO: 204426

SEQ ID NO: 204497 - DNA, 601 bp, Human; identical to SEQ ID NO: 204427

SEQ ID NO: 204498 - DNA, 601 bp, Human; identical to SEQ ID NO: 204428

SEQ ID NO: 204499 - DNA, 601 bp, Human; identical to SEQ ID NO: 204429

SEQ ID NO: 204500 - DNA, 601 bp, Human; identical to SEQ ID NO: 204430

SEQ ID NO: 204501 - DNA, 601 bp, Human; identical to SEQ ID NO: 204431

SEQ ID NO: 204502 - DNA, 601 bp, Human; identical to SEQ ID NO: 204432

SEQ ID NO: 204503 - DNA, 601 bp, Human; identical to SEQ ID NO: 33089

SEQ ID NO: 204504 - DNA, 601 bp, Human; identical to SEQ ID NO: 33090

SEQ ID NO: 204505 - DNA, 601 bp, Human; identical to SEQ ID NO: 33091

SEQ ID NO: 204506 - DNA, 601 bp, Human; identical to SEQ ID NO: 33092

SEQ ID NO: 204507 - DNA, 601 bp, Human; identical to SEQ ID NO: 33093

SEQ ID NO: 204508 - DNA, 601 bp, Human; identical to SEQ ID NO: 33094

SEQ ID NO: 204509 - DNA, 601 bp, Human; identical to SEQ ID NO: 33095

SEQ ID NO: 204510 - DNA, 601 bp, Human; identical to SEQ ID NO: 33096

SEQ ID NO: 204511 - DNA, 601 bp, Human; identical to SEQ ID NO: 33097

SEQ ID NO: 204512 - DNA, 601 bp, Human; identical to SEQ ID NO: 33098

SEQ ID NO: 204513 - DNA, 601 bp, Human; identical to SEQ ID NO: 33099

SEQ ID NO: 204514 - DNA, 601 bp, Human; identical to SEQ ID NO: 33100

SEQ ID NO: 204515 - DNA, 601 bp, Human; identical to SEQ ID NO: 33101

SEQ ID NO: 204516 - DNA, 601 bp, Human; identical to SEQ ID NO: 33102

SEQ ID NO: 204517 - DNA, 601 bp, Human; identical to SEQ ID NO: 33103

SEQ ID NO: 204518 - DNA, 601 bp, Human; identical to SEQ ID NO: 33104

SEQ ID NO: 204519 - DNA, 601 bp, Human; identical to SEQ ID NO: 33105

SEQ ID NO: 204520 - DNA, 601 bp, Human; identical to SEQ ID NO: 33106

SEQ ID NO: 204521 - DNA, 601 bp, Human; identical to SEQ ID NO: 33107

SEQ ID NO: 204522 - DNA, 601 bp, Human; identical to SEQ ID NO: 33108

SEQ ID NO: 204523 - DNA, 601 bp, Human; identical to SEQ ID NO: 33109

SEQ ID NO: 204524 - DNA, 601 bp, Human; identical to SEQ ID NO: 33110

SEQ ID NO: 204525 - DNA, 601 bp, Human; identical to SEQ ID NO: 33111

SEQ ID NO: 204526 - DNA, 601 bp, Human; identical to SEQ ID NO: 33112

SEQ ID NO: 204527 - DNA, 601 bp, Human; identical to SEQ ID NO: 204457

SEQ ID NO: 204528 - DNA, 601 bp, Human; identical to SEQ ID NO: 204458

SEQ ID NO: 204529 - DNA, 601 bp, Human; identical to SEQ ID NO: 204459

SEQ ID NO: 204530 - DNA, 601 bp, Human; identical to SEQ ID NO: 204460

SEQ ID NO: 204531 - DNA, 601 bp, Human; identical to SEQ ID NO: 204461

SEQ ID NO: 204532 - DNA, 601 bp, Human; identical to SEQ ID NO: 204462

SEQ ID NO: 204533 - DNA, 601 bp, Human; identical to SEQ ID NO: 204463

SEQ ID NO: 204534 - DNA, 601 bp, Human; identical to SEQ ID NO: 204464

SEQ ID NO: 204535 - DNA, 601 bp, Human; identical to SEQ ID NO: 204465

SEQ ID NO: 204536 - DNA, 601 bp, Human; identical to SEQ ID NO: 204466

SEQ ID NO: 204537 - DNA, 601 bp, Human; identical to SEQ ID NO: 204467

SEQ ID NO: 204538 - DNA, 601 bp, Human; identical to SEQ ID NO: 204468

SEQ ID NO: 204539 - DNA, 601 bp, Human; identical to SEQ ID NO: 204469

SEQ ID NO: 204540 - DNA, 601 bp, Human; identical to SEQ ID NO: 204470

SEQ ID NO: 204541 - DNA, 601 bp, Human; identical to SEQ ID NO: 204471

SEQ ID NO: 204542 - DNA, 601 bp, Human; identical to SEQ ID NO: 33113

SEQ ID NO: 204543 - DNA, 601 bp, Human; identical to SEQ ID NO: 33114

SEQ ID NO: 204544 - DNA, 601 bp, Human
catttttggagccttctaaatgtctggcttaatagaacacagctggattctcatacctgcatctgtctccactcttggaatgtgttgctttggttgacttttatggagcagctcaatccttgcacagataaatagttggaaatgggaggagtaatcaaataattctggatattcatatttgattctataccaaaactcaataagcagtagtttctatgaaggttagttgcaatgtgaaacctaaaaccttatcaataaactcttcatacttttacattagagttcatcatttggctgggcrcggtggctcactcctgtaaccccaggactttgggaggccaaggcgggcggattacctgaggtcagtagtctgagaccagcctggctaacatggcaaagccccatctctactaaaaacacaaaaactagctgggcatggtggtgggcccctgtagtcccagctacttgggaggctgaagccatagaatcacttgaacctgggaggtggagtttgcagtgagcccagattgcgccactgcactcccgcctgggcgacagggtgagactctgtatcaaaaaaaaaaaaaaaaaaaagtcactt

SEQ ID NO: 204545 - DNA, 601 bp, Human
tggctgggcacggtggctcactcctgtaaccccaggactttgggaggccaaggcgggcggattacctgaggtcagtagtctgagaccagcctggctaacatggcaaagccccatctctactaaaaacacaaaaactagctgggcatggtggtgggcccctgtagtcccagctacttgggaggctgaagccatagaatcacttgaacctgggaggtggagtttgcagtgagcccagattgcgccactgcactcccgcctgggcgacagggtgagactctgtatcaaaaaaaaaaaaaaaaamaagtcactttatcttgtactccgactggatcctttaccagtgcatacatttgtaaggtgttggtgatttggaaaggacctgttcactgagccaggcagagccatgcagatgttccagatgttggtacattttgttatacagtatcaaagtcacattcaccatagctgttagaaaagtctctgagtattgaaagactgtcaggcttatgttgatggatacaggttttccgaaactcttttttgcttgaaagcttaaattttaccattggcaacaaatactgttattttggccaggtgctgt

SEQ ID NO: 204546 - DNA, 601 bp, Human
gtggaggtgtgggctaggataatttaaggctaatcctagtcacctatccttctaaaatagttcttatttttttaaattttaatcctcatctttgtgttggtaaatattacatactttagagcaatttttgtttcaatttttatggctaccgtagtagatgtatcttatatattctttctttgttttttttgttttttgttttgttttgttttctgaggcagagttttactcttgttgcccaggctggaatgcagtggcactatctcggctcaccacaacctccgcctcctgggttcaagcrattctcctgcctcagcctcccgagtagctgggattacaggcatgtgccaccacacctggcaaattttgtatttttagcagagatagagcagaaacagagggtttctacatgttggtcaggctggtctcgaactcccgacctcaggtaatctgcctgcctcggcctcccaaagtgctgggattacaggtgtgagccaccgagcccggcctttttttttgagatggagtctcactctgcctcccaggctagagctcagtggcgcgatctcagctcactgcagcctccgccaccacccctcag

SEQ ID NO: 204547 - DNA, 601 bp, Human
aggctgaggcggctggatcactggaggtcaagagttcgagaccgaaaccagcctggccaacttggtgaaaccccatctctactaaaaatacaaaaattagccaggcgtggtggcaggtgcctgtaatcccagctactcgagaggctgagagaggagaatcgcctgggcaacagagtgagactctgtctcaaaaataaaaaaaaaaagagggaagagtattccaagtagagggaacagcacatgcaaatgctcagaggcagaaaggagcgtcatgcgtacagaagagggagagagcgtgggkgtggctggggcagtctgctgcaatgcaggtggacctgggtgacttggaggtgtgcggggagtttcattttcatcctaataatgagagctacgggagggtttaaaccaagatgagtatgatggaaggaactagcagcaatttcttacctattctctgcagtttaaaaaactgtaattgagctgggcatggaggctcatgcctgtaatctcagcactttgggaggccgaggtggaaggatcacttgaggtcaggagttcaagaccagcctgggcaacatgggaaaaccctgtctctgctaaa

SEQ ID NO: 204548 - DNA, 601 bp, Human
gttccagttacttggcagcctgaagtaggagatccgcttgagcccaggaggtcgaggctgcggtgagttttgatcacaccactgcactccaacctgggtgacccagcgagaccctgactcaaaaacaaaacaaaaaaaggatggtgggagcggctggaggataccaatggaagagtgatgggaccttgttcacatcccttgggccactgtgcagagaacggattgtagggttaagagccaggtggggataccagtgaggaggctgtggttatccgggggagggaagggctcattaccatgygtgggcaatcagggaagacttcctggaagaagcgtgaatgagctcagccttgataatgggggcagggcagtgggtggagtttgaaaatgagaagaggaggaggaggaaggatctgcagacagtgggggaaggtcgtgagtcaaggcacccagtgggctgagcttggtccagtgaggagtgaggctgtgtaacctaatggctagagaagggcacccgcccagcccaaccctggggctggggcatggcgtgcagcgagagtcttattgaaccttctgggtactttcccctttgttcctcccc

SEQ ID NO: 204549 - DNA, 601 bp, Human
ttattgaaccttctgggtactttcccctttgttcctccccgatctagagaggcccaaattctggctgtgatccagctctcatgcccctcctagccctgctcctgctgtgtgaccctgggagagtgacctaacctctctgagccacaaatgggataatagcatctccctaatgggatcaagcgagttaatgaacatggagtgcctgcaggtagaaaactcattaaagattaatttctttccctttcacccatccatcatctcattacaggaaaatttgaaagtgataaaagaaaaaaacgtycattatcctttaaccttctcccttcccccttaccacttaacctcatcactgcacagcctaaccaggattccgtgaaggatggaccatgtttatcgtggtcccacaggattctaacagagctgagcatttcctattgccgacattggcagttcctgagttttagccattgtcatgttgcagcgcaattactttattttatttattattattattattttttttgagatacagtctcgctctgtcacccaggctggagtgcagtggtgcgatctcggctcactgcaacctccacctcccggg

SEQ ID NO: 204550 - DNA, 601 bp, Human
aactccaggagagagaaagggagaattctgctgcttttgttcctgttccaagatcttgagaaaaaaaaaaaaaaaaaaaagcctctgggaagagtgacaggtggaagagccagggaaggacggtccccccagtcctgttggcccttcgggctccctcacccacccatgcaactgtccatctgttctccgaggggctggaggcggccacatccatcagaggctgggaccctgggcagtgggcagctcgagatgtgtgtggcagaggccggggcctggcagtggtttgtggggaggggagcaygctggagtctgctctgggaacggggttgtggctgcctcccaaaacatgagctcagcctccggcagaggatctggccaagggacagggcctggactggtgcccttgctgcccacccagtggagaggggagggcctgtatcctcagagctgtgccacacagggagcagcatttgagggggacctttgagagggtctctcacactaggaggtggtgcagggctacaagggagaggtggtcagagcaggtgggcaggagggcggtttgggatccacctgggggcaaagtcctgggtggagcagc

SEQ ID NO: 204551 - DNA, 601 bp, Human
caggagtttgagaccagcctggccaacatggtgaatcctcgtctctactaaaaatacaaaaattagctgggcgtggtggcacacatctgtaatcccaggtacttgggaggctgaggcaggagaatcgcttgaacccgggaggttgaggttgcagtgagcttagatcacgccattgcacttcagcctgggcaacagaacgagactccatctcaaaacaacaaaaaaaagttggggggctgggctgcagtgacctggatcctgggtgaggactgatgggactgatgagcacaggggccaaccrtgtgccattgttttcattttaaagatgagaccattggctgggtatggtggctcatgcctgtaatcccagctctttgggaggccgaggagggcagatcacttgaggtcaggagttcgagaccagcctggccaacatggtgaaacctcgtctctactaaaaataacaaaaattagccgggcgcgacggcacatgcctgtaatcccagctactcaggaggctgaggcaggagaatggcttgaacctggaaggcagaggttgtagtgagccaagtttacaccattgcactccagcctgggcaac

SEQ ID NO: 204552 - DNA, 601 bp, Human
attcttctgcctcagcctcccaagtagctgggattacaggcatgtgccaccacactcagctaatttttgtatttttagtagagttggggtttcaccatcttggccaggctggtctcgaactcctgatctcaagtgatccacctgcctcggcctcccaaactgctgggattacaggcgtgagccacttcactcggtcagcattgtggttctagttcactgagctcaatgtccctgtaccccgtgagtgttccagaccttggcaccaacctgaagtgcccgaggtggggcccccacccccacmgaggatggtgcctttctctttcctttccatacatttctaggagccttcccagccccaggagagcaggtaggattgtccccattttaagtgacttgtctgagatgttgggcaaattcgtcccttcaagggcaacttctcggctctccactgaccacatcctaaactttttaatggcatcaggacggggaagccaagcccgctcttctgtggctggtgggggtgggggcagggctgcctcctaatgtccctgacgtggtccaggatcgatctgacggggcgggggtccggctgccagcacct

SEQ ID NO: 204553 - DNA, 601 bp, Human
gggggcagggctgcctcctaatgtccctgacgtggtccaggatcgatctgacggggcgggggtccggctgccagcacctgtctgcctgcctggtggcctggccacgggcttctccatggggagctggctctgttctttccagggtaagccatccgggccgctcttgccctgggttccccggccgcctctgctgagcagagactctgttctcctggtttgggaggagggggcacagaagtggggtttggagttccatttggttcaggaagaatgcccagcagagcctgggattcaggacggwgtgggctgctggagggaggaacccttctttagggctggatgctgcagaggctgggcctggggtggccacaggagagaggtgagtttcagacggacccctccctggtcggggtgggctgggggatgtagactcggtcctccctggagcaggcatggactgaggggtggaaacaggttggggtggacccaatgcggggactgccggagggaaagtggcctcttcaaggaatgctgtggagaccccattccttccttcgtaacctctgcctttgagcaccttcgggagagaaaaggaggctca

SEQ ID NO: 204554 - DNA, 601 bp, Human
ggctgccagcacctgtctgcctgcctggtggcctggccacgggcttctccatggggagctggctctgttctttccagggtaagccatccgggccgctcttgccctgggttccccggccgcctctgctgagcagagactctgttctcctggtttgggaggagggggcacagaagtggggtttggagttccatttggttcaggaagaatgcccagcagagcctgggattcaggacggtgtgggctgctggagggaggaacccttctttagggctggatgctgcagaggctgggcctggggtgrccacaggagagaggtgagtttcagacggacccctccctggtcggggtgggctgggggatgtagactcggtcctccctggagcaggcatggactgaggggtggaaacaggttggggtggacccaatgcggggactgccggagggaaagtggcctcttcaaggaatgctgtggagaccccattccttccttcgtaacctctgcctttgagcaccttcgggagagaaaaggaggctcaggagagaaagccatttgagatttttggggcactgatgcatgttcctttggggccaccaggaagcg

SEQ ID NO: 204555 - DNA, 601 bp, Human
tggtcgccttatttatagcccctcctttgtggtcaccgtgctcattggtacatcaaaggctctgaaaagtcctgcagacaagtacccttcactttgttgaagttgctgtttctcaagcttctttgaacttggaggttaaattgtttgtttgtttgtttgtttgtttgttttcataatacctaggaacagcctgtggagctatgttctgtggaacatttaagaaggaaccagatcctagcagaggacacttttttatctgcccccaaaccactggggcagagggctgagttcatcacacatctcacttcatcacatgtcaacattgtgggtccctgcaaggtccctcttggttattttatttatctatttatttatttatttatttattatttgagacagagtcttgctctgtggcccaggctggagtgcaatggcacgatctcagctcactgcaacctctgcctcctgggttcaagcaattctcctgcctcagcctcccgagtagctgggattacaagcgcgcgccaccacactgactaatttttgtagttttagtagagacggggtttcgccatgttggtcaggctggtctcgaactcct

SEQ ID NO: 204556 - DNA, 601 bp, Human
ggcacgatctcagctcactgcaacctctgcctcctgggttcaagcaattctcctgcctcagcctcccgagtagctgggattacaagcgcgcgccaccacactgactaatttttgtagttttagtagagacggggtttcgccatgttggtcaggctggtctcgaactcctggcctcaagccatccgcctgccttggcctcccaaagtgctgcaattacagatgtgagccactgcatccggctattttttattttctattatttttacttttttgtagagatgagatctctctatgttgcccrggctcatcttgaactcctggcctcaagcgatcctcctgcctcagcctcctcagtagctgggactacaggcttgagccactgtgcctagcttcctcttggtgtttcttttctttttttttttttttttctttcttttttgagatggagtctcgctcccgtcacccaggctgaagtgcagtggcgcaatctcggctcactgcaatctccacctcctaagttcaagcgattctccttcctcagccttccgagtagctgggattacaggtatgcgccaccatgccttgctaatttttgtatttt

SEQ ID NO: 204557 - DNA, 601 bp, Human
gatctcagctcactgcaacctctgcctcctgggttcaagcaattctcctgcctcagcctcccgagtagctgggattacaagcgcgcgccaccacactgactaatttttgtagttttagtagagacggggtttcgccatgttggtcaggctggtctcgaactcctggcctcaagccatccgcctgccttggcctcccaaagtgctgcaattacagatgtgagccactgcatccggctattttttattttctattatttttacttttttgtagagatgagatctctctatgttgcccgggctsatcttgaactcctggcctcaagcgatcctcctgcctcagcctcctcagtagctgggactacaggcttgagccactgtgcctagcttcctcttggtgtttcttttctttttttttttttttttctttcttttttgagatggagtctcgctcccgtcacccaggctgaagtgcagtggcgcaatctcggctcactgcaatctccacctcctaagttcaagcgattctccttcctcagccttccgagtagctgggattacaggtatgcgccaccatgccttgctaatttttgtatttttagta

SEQ ID NO: 204558 - DNA, 601 bp, Human
ttttcttttcgttttctttttctttctttctttctttctttttttttttttttttttgagacagagtctcactctgtctcgcccagactggagtgagtgcagtggcgtgatctcggctcactgcagcctctgcctcctgggtccaagtgattctcctgcctcagcctcctgagtagctgggactttagatgcctgccaccacacccagctaattttgtgttttttaagtagagacggggtttcaccatgttggccagactggtcttgaactcctgaactcaggtaatccacccgcctcagyctcaaagtgctgggattacaggtgtgatccaccacgcccagccgggatcagtttcattctacatcttcctgtgtcatttgaatcatttacaaggagagtgtatttgtgtcttaaagaaaaaaatgtggtcacatgtaggcagtagctaaagctgtagcagttggtagattattgtggtgggtggggggcaccatgtagatcggggtcccctgctactgatcagagaagaaggtttgttgttgttggggttttttgttttttggagatggagttttgctcttttgcccaggctggagtgaa

SEQ ID NO: 204559 - DNA, 601 bp, Human
gagagtgtatttgtgtcttaaagaaaaaaatgtggtcacatgtaggcagtagctaaagctgtagcagttggtagattattgtggtgggtggggggcaccatgtagatcggggtcccctgctactgatcagagaagaaggtttgttgttgttggggttttttgttttttggagatggagttttgctcttttgcccaggctggagtgaagtgatgcgatctcggctcactgcaacctccgccccccaggttcaagtgattctcctgcctcagcctctcgagtagctgggattacaggtgcccrccaccatgccaggccaatttttgtatttttagtagagacgaggtttcaccatgttgaccaggctgttcttgaactcctgacatcaggtgatctgctcacctcagcctcccaaagtgctgggattccaggcatgagccactgtgccccgtgtaatttttttctcagaggcagtgtctccctattgcccaggctggattgcagtggtgggatcatgcctcactgcagcctagaattctcttttttttttttttttttttagagatggggtcttgctatgttgtccaggctggtcttcaactc

SEQ ID NO: 204560 - DNA, 601 bp, Human
cgagtagctgggattacaggtgcccgccaccatgccaggccaatttttgtatttttagtagagacgaggtttcaccatgttgaccaggctgttcttgaactcctgacatcaggtgatctgctcacctcagcctcccaaagtgctgggattccaggcatgagccactgtgccccgtgtaatttttttctcagaggcagtgtctccctattgcccaggctggattgcagtggtgggatcatgcctcactgcagcctagaattctcttttttttttttttttttttagagatggggtcttgctrtgttgtccaggctggtcttcaactcctgacctcaagtgatcctcctgccctggcctcccaaagagctgggattacaggcacaaaccaccatgcccaaccagggtgatgagttttagataaagcagtcaggaaaggcttctctgaggaggtgagggagccagctctgtaactttcctggggcaagaggtcgtgggaaatacccacacccacatcattcgaggtggagccctccctcccgctcccccgggtaccacattttgggttccttcctcagttacgcacgtggcgtggcaagctgaa

SEQ ID NO: 204561 - DNA, 601 bp, Human
atggatatggggtaggagctggcacctgccaggcacccactgtgcgtgtggtcaagagggagggttctggctgggcgtggtagcttgcacctataatcccagcactttgggaggccaaggcaggagggtcacttgaggccagaagtttgagaccagccttaccacatggcaaaaccccgtctctaataaaatacaaaaaaaaaaaaaaaaatagcctggtgtgctggcacgcacctataatcctggctacactggaggccgaggcatgagaattgcttaaacctgggaggcgaagattgcrgtgagcagagattgcaccattgcactccagcctggggactccagcctgggcaacagagtgagactctgtctcaaaaaaacaaaagagggagggttctgaagccagactagctgggtgtcctactcggcctgagtgaccttaccctctgtttccaaatctgcaaggtaaaaatatgatgtattcttataatgaatagcccagcgtggtggtgcatgcctgtaatcccagctactcgggaggctgaggcaggagaatcacttgaactcaggaggtggaggttggagtgagccgagattgcac

SEQ ID NO: 204562 - DNA, 601 bp, Human
ttccttccttccttccttccttccttccttcctttctctttttttctttctttttttcttccttccttcctttctttcttttctttctttcttttctttttttttttgatggagtctcactctgtcgcccaggctagagtgcagtgacacgatctcggctcactgcaacctccgacttccgggttcatgccattctcctgcctcagcctcctgagtagctgcgactacaggcgcccaccaccacgcctgactaattttttatatttttagtagagacagggtttcaccatgttagccaggwtggtctcaatctcctgacctcgtgatccgcccgcctcggcctcccaaagtgctgggattacaggcgtaagccactgcgcctggcctctcttcttttctcttttttcttttctattcttttcttttctttcagatagagtcttgctctgtcacctaggctggagtgcaatggtgccatcttggctcactgcaacctccgcctcctgggttcaagcaattctcctgcctcagcctcccaagtagctgggactacaggcatatgccaccacgcctggctaatttttgtattttcagtagagat

SEQ ID NO: 204563 - DNA, 601 bp, Human
gagggcgtactttcctggggacgctctggagggctggaagagtagggggagacctgaggaggacctgcccaagaccacacagccaaccattcctgcctcggtttccatggcaagaccatgtctctacaaaaaaatacaaaaattagcccagtgtagtggcaggtgtctgtggtttcagctactcgggaggctgaggtagaggattgctggagcccaggaagtcaagactgcagtgagccaccatatcgccaatgcactctagtctgggtgacagagcaagaccctgtctcaaaaagtaaayaaacaggggttgggtgtggtgcctcacgcctgtaatcccagcaatttgggaagccaaggcgggcggatttcttgaggtcaggagttcgagaccagcctggccgagatggtgaaaccccatctctacccaaaaatacaaatcagccacctcccaaccctagactctgtgctcctggggccacccaggggccagccctaacagccacctctttccctttccctctccttctctgcaggctccccactgcacaaacagtcatctggaccctcctcctccccggccgcagctgctgcccccgag

SEQ ID NO: 204564 - DNA, 601 bp, Human
catggcaagaccatgtctctacaaaaaaatacaaaaattagcccagtgtagtggcaggtgtctgtggtttcagctactcgggaggctgaggtagaggattgctggagcccaggaagtcaagactgcagtgagccaccatatcgccaatgcactctagtctgggtgacagagcaagaccctgtctcaaaaagtaaataaacaggggttgggtgtggtgcctcacgcctgtaatcccagcaatttgggaagccaaggcgggcggatttcttgaggtcaggagttcgagaccagcctggccgasatggtgaaaccccatctctacccaaaaatacaaatcagccacctcccaaccctagactctgtgctcctggggccacccaggggccagccctaacagccacctctttccctttccctctccttctctgcaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtat

SEQ ID NO: 204565 - DNA, 601 bp, Human
ggcaggtgtctgtggtttcagctactcgggaggctgaggtagaggattgctggagcccaggaagtcaagactgcagtgagccaccatatcgccaatgcactctagtctgggtgacagagcaagaccctgtctcaaaaagtaaataaacaggggttgggtgtggtgcctcacgcctgtaatcccagcaatttgggaagccaaggcgggcggatttcttgaggtcaggagttcgagaccagcctggccgagatggtgaaaccccatctctacccaaaaatacaaatcagccacctcccaaccytagactctgtgctcctggggccacccaggggccagccctaacagccacctctttccctttccctctccttctctgcaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacg

SEQ ID NO: 204566 - DNA, 601 bp, Human
gggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagacyggcaacgagtcgggatccaacctctcagacagcggctctgtgaagcggggcgaaaaggacctgcgcctgggggaccgcgtgctggtgagtgcgggcagtactgggctctgggcccagcttcccttccctcccctgctccgccccacttggcgaagctggacccccctgggctgggcagggtggggactcgaagggggctcggacagggtccagcctgggacacccattccttatcaggaccatacagagtgacaagagagacaggtaatgtgggctctggagactgttgctgtgtgacct

SEQ ID NO: 204567 - DNA, 601 bp, Human
agagtgacaagagagacaggtaatgtgggctctggagactgttgctgtgtgaccttgggcaagtgtcctaaactttctgggcctcgctctttctatcggtaaaatgggatatttatttatttacttattttacttatttatttatttatttatttatttttgagatggagttttgttcttgtcgtccaggctggagtgcagtggcgtgatttcagctcactgtaacctccacctcccaggttcaagcaattctcctgtctcaccctccctagtagctgggattacaggcatgtgccaccaygcccggctaatttttgtattttcagtagagacggggtttcaccatgttgaccagactggtcttgaactcccgacctcaggtgatccacccgccttggcctcccaaagtgcttggattacaggtgtgagccccagcgccctaccaaaatgggaattttaatcgtacttcagtcatagttggagatgcattaaaacgtatcactcatttagacagtgcctaatactaagtacccatacattttggctattattgatattatctattgatccagctcatccacatgcatgtgccaggcatgta

SEQ ID NO: 204568 - DNA, 601 bp, Human
tcagctacaactcgagtgatcagtgttattgaagttgagagaattgggtcactggagctgacagcttcctgccaggggcccctcttctccactagtcccagctgttggggccaggttggaaaggggacagtgacccccaagtcttctagagtctgaatacagcagtgacctgggttggtggtagtcaggtggatgggacagggctgtgtcttgctgtccagccaggctgtggtggccttgggctaaccctgcacctgggaccacagtgttgggaagagactcatagggtacagggaaggcyctgacatggacttctgggcctggggtgtgaggagctgtcagtggggcaggggtccctgtgtcctgtctgcaaggcttcctgggggaaggtggttggtcattccaacccgaggtggggagcacaggcttggagctccaaagccgagtggagaagggcaggggctctggggacccagagcagggatccccaaagcatattgctgcctgggatcctcccttcctgctctgagaacctggcaaaggtttctcctggaggtttctgggaggagcctttggggttgtgggtaggggagcgagagga

SEQ ID NO: 204569 - DNA, 601 bp, Human
gaattgggtcactggagctgacagcttcctgccaggggcccctcttctccactagtcccagctgttggggccaggttggaaaggggacagtgacccccaagtcttctagagtctgaatacagcagtgacctgggttggtggtagtcaggtggatgggacagggctgtgtcttgctgtccagccaggctgtggtggccttgggctaaccctgcacctgggaccacagtgttgggaagagactcatagggtacagggaaggctctgacatggacttctgggcctggggtgtgaggagctgtcrgtggggcaggggtccctgtgtcctgtctgcaaggcttcctgggggaaggtggttggtcattccaacccgaggtggggagcacaggcttggagctccaaagccgagtggagaagggcaggggctctggggacccagagcagggatccccaaagcatattgctgcctgggatcctcccttcctgctctgagaacctggcaaaggtttctcctggaggtttctgggaggagcctttggggttgtgggtaggggagcgagaggaaatgtttacacccatggccccgttgaatcttcaagcctgt

SEQ ID NO: 204570 - DNA, 601 bp, Human
cagtgacctgggttggtggtagtcaggtggatgggacagggctgtgtcttgctgtccagccaggctgtggtggccttgggctaaccctgcacctgggaccacagtgttgggaagagactcatagggtacagggaaggctctgacatggacttctgggcctggggtgtgaggagctgtcagtggggcaggggtccctgtgtcctgtctgcaaggcttcctgggggaaggtggttggtcattccaacccgaggtggggagcacaggcttggagctccaaagccgagtggagaagggcaggggstctggggacccagagcagggatccccaaagcatattgctgcctgggatcctcccttcctgctctgagaacctggcaaaggtttctcctggaggtttctgggaggagcctttggggttgtgggtaggggagcgagaggaaatgtttacacccatggccccgttgaatcttcaagcctgtgctgtgatgctgcgatgtgattttatcatcctcactttatggatggggaaactgaggctcagggaagtttttgtttgtttgttttttgttttgttttgtttttctagtctcactctgttgcc

SEQ ID NO: 204571 - DNA, 601 bp, Human
tctgacatggacttctgggcctggggtgtgaggagctgtcagtggggcaggggtccctgtgtcctgtctgcaaggcttcctgggggaaggtggttggtcattccaacccgaggtggggagcacaggcttggagctccaaagccgagtggagaagggcaggggctctggggacccagagcagggatccccaaagcatattgctgcctgggatcctcccttcctgctctgagaacctggcaaaggtttctcctggaggtttctgggaggagcctttggggttgtgggtaggggagcgagaggwaatgtttacacccatggccccgttgaatcttcaagcctgtgctgtgatgctgcgatgtgattttatcatcctcactttatggatggggaaactgaggctcagggaagtttttgtttgtttgttttttgttttgttttgtttttctagtctcactctgttgccaggctggagcgcagtggtgcgttctcggctcactgcaacctccacctcccaggttcaagcaatcctcctgcctcagcctcccgagtagctggggctacaggcacgcaccatcacgccctgctaattttttgtattttt

SEQ ID NO: 204572 - DNA, 601 bp, Human
caaggcttcctgggggaaggtggttggtcattccaacccgaggtggggagcacaggcttggagctccaaagccgagtggagaagggcaggggctctggggacccagagcagggatccccaaagcatattgctgcctgggatcctcccttcctgctctgagaacctggcaaaggtttctcctggaggtttctgggaggagcctttggggttgtgggtaggggagcgagaggaaatgtttacacccatggccccgttgaatcttcaagcctgtgctgtgatgctgcgatgtgattttatcatcctcactttatggatggggaaactgaggctcagggaagtttttgtttgtttgttttttgttttgttttgtttttctagtctcactctgttgccaggctggagcgcagtggtgcgttctcggctcactgcaacctccacctcccaggttcaagcaatcctcctgcctcagcctcccgagtagctggggctacaggcacgcaccatcacgccctgctaattttttgtatttttagtagagatagggtttcaccatgttggccaggatggtcttgatctcttgacctacccacctcggcctccc

SEQ ID NO: 204573 - DNA, 601 bp, Human
tgcagtgagctgagatggtgcggctccactccagcctgggcaacagagcaagactccgtctcaaaaaaaaaaacaagaaaaaaacccagagtggagcaggaacggcagggcccaggaaggaggctggactcctggacccctgcaccatcctgtccaaggaacttgttttgggaccgtcactctgctcttcctcctgtggctcccaggaaagccaaccccatccaacaggacctgggcaaacagcttagtctccctgacctgtccttcaggatctccggggtctgtgggcacctactggggrtgggtacagcagggaaatcaggcccaggtctgtgatattgggcaagtcacttacagagcctcatcttcattcattcattcattcattcattcattctccatgtgtctgttcagcaaaatggccatggcccagcactcttgttttgctttatgcttttatggagagcattaagagagctgatggcagccgggcacggtggctcgtgcctgtaatctcagcactttgggaggccaaggcaggcggatcactcaaggtcaggatttggaaaccagcctgggcaacatagcaagaccccgtctc

SEQ ID NO: 204574 - DNA, 601 bp, Human
aggaaagccaaccccatccaacaggacctgggcaaacagcttagtctccctgacctgtccttcaggatctccggggtctgtgggcacctactgggggtgggtacagcagggaaatcaggcccaggtctgtgatattgggcaagtcacttacagagcctcatcttcattcattcattcattcattcattcattctccatgtgtctgttcagcaaaatggccatggcccagcactcttgttttgctttatgcttttatggagagcattaagagagctgatggcagccgggcacggtggctcgygcctgtaatctcagcactttgggaggccaaggcaggcggatcactcaaggtcaggatttggaaaccagcctgggcaacatagcaagaccccgtctctactaaaaatacaaaaaaaaaaaaaatagccgggcatggcggtgcatgcctatgctcccagctactggggagactgaggtgggaggatcacttgaactcagggggtcaaggctgcagtgagccacgatgggaccactgcactccagccagggtgacagagtgagacgctgtcttaaaaaaaaaagagagagagagagaactggt

SEQ ID NO: 204575 - DNA, 601 bp, Human
caagcactttgggaggctgaggcaaatggattgcttgagcccggaagtttgagaccagcctgggcaatgtgacgaaaccccatctctacaaaaaatagccaggcgtggtgccctgtgcctgtagtcccagctacttgggaggctgaagtgggaggatcgcttgtccaggaggccaaggttgtggtgagccgagatcacgccactgcattccagtgtcaaaaaaaaaaaaaaaaaaaaaagaataaaacattttcagatatagaaagctcgaaaatttacctcctcgtgcatcttttcttaraaagctgtgggaagatgtgctctactaaaataagtagtaaaccagccagacgtggtggctcacacctgtaatcccatcactttgggaggctgaggagggcagatcacctgaggtcagaagtgcgagaccagcctggccaacatggcgaaaccccgtctctactaaaaatacaaaaattagccgggcatggtgacaaacgcctataatcccagctactccggaggctgatgctggagaatcgcttgaacctgggaggcggaggtttcagtgagcggagatcgcgtcattgcactccagcct

SEQ ID NO: 204576 - DNA, 601 bp, Human
cagagtactggcaggggaagagcaggaccctgggagtcaaggcacttgggctcccacctgctatgttgctgtagattaggctggacagagccagtctgccctgcagtgcttcagatccctgagacccgcctgcatccacaccttcctgcagctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcaggtgagtggcaggtggggctgggggcagagcttctccagccagcctcatagagtctcacccactcagagcggagaccctggagggggtgggtgcagagaaatatgaagataacacaagcagtacctgtcccccgctttccagagataagcctcagtgacctggtgaatttccttccagtcttttctgcctatgtataaggatacatacacctactttcagaatctggttacaagcttgtatatcctgcttttt

SEQ ID NO: 204577 - DNA, 601 bp, Human
gcaatctcagctcactgcaacctccacctcccaggttcaagcgattctcctgcctcagcctctcaagtagttgggattacagcacctgctaccaaaccaggctaatttttgtattttaagtagagatggggtttcaccctgttggtcaggctggcctggaattcctgacctcaagtgatctgcctgccttggcctcccaaagtgctgggattacaggtgtgagccaccatgcccagccctgcttttttatttttttaaaatatttttaatatagggatggggtcatgctgtgttggtcagsctggtctcgaactcctggcctcaggcaatccttggccttccaaagtgctaggattacaggtgtgagccactgcacttggcctaatctgcttttcttccccggctacttattatactgcaagcattttctaggtcctggcaaattcctcatcattcttttttttttttattttatttttttcttttagagatagggccttgctttgttgcccaggttggagtgcagtgacgccatcatagctccactcctgggttcaagtgatcctcccacctcagcctcctgagtggctgggactatagg

SEQ ID NO: 204578 - DNA, 601 bp, Human
tgagtcacagaatttataggtaggaaaactgaggctcagagaccaagggagctgggtatggtggctcacacctataatcccagcacttcaggaagccaaggcagaggatcacttgagcccagaagttcaagaccagcctgggcaacgtagcaagatcccatctctacaaaaaatttaaaaagttagccaagcatggtcatgtgcacctgtggtcccagctactcagggaggctgaggctagaggatcgcttgaatctgggagatggaggctgcagtgagctatgattgcgcctgtttttttttgtgtgtgtgtgtgtgtgtgtgtgtgtgtgtgtgtgtgtgtgtgtgtgtgtgtgtgactgtctcaaaaaaaagaatggatgttggggcacaacccagcgtcagagcctcagcccagctcagcatgttctaattaagtttccctcttggccaaggggcaggccatgtggttgctcctggctgacttttccattggcagttgctctcctgcaggggttggatggacttctgggaaaagcacctgtatttgccaggaacagagacccccctgtgccagctgcagtcaccatgggggcttact

SEQ ID NO: 204579 - DNA, 601 bp, Human
agtcacagaatttataggtaggaaaactgaggctcagagaccaagggagctgggtatggtggctcacacctataatcccagcacttcaggaagccaaggcagaggatcacttgagcccagaagttcaagaccagcctgggcaacgtagcaagatcccatctctacaaaaaatttaaaaagttagccaagcatggtcatgtgcacctgtggtcccagctactcagggaggctgaggctagaggatcgcttgaatctgggagatggaggctgcagtgagctatgattgcgcctgttttttgtggtgtgtgtgtgtgtgtgtgtgtgtgtgtgtgtgtgtgtgtgtgtgtgtgtgtgtgactgtctcaaaaaaaagaatggatgttggggcacaacccagcgtcagagcctcagcccagctcagcatgttctaattaagtttccctcttggccaaggggcaggccatgtggttgctcctggctgacttttccattggcagttgctctcctgcaggggttggatggacttctgggaaaagcacctgtatttgccaggaacagagacccccctgtgccagctgcagtcaccatgggggcttactga

SEQ ID NO: 204580 - DNA, 601 bp, Human
gaggttgaggtgggaggatcgcttgagtccgggcagttgaggctgcagtgagctgtgatcacaccactgtactccagcctgggcaacaaagcaagagcaagaccttgtctcaaaaaataaaaaataaaggccgggcgcggtggctcacgcctgtaatcccagcactttgggaggccgaggtgggcggatcatgaggtcaggactttgagaccagcctgaccaacatagtgaaaccccgtctctagtaaaaatacaaaaacttagccgggcctggtggtgggcgcctgtaatcccagctatmcaggaggctgaggtaggagaatcgcttgaacctgggaggcggaggttgcagtgagccgagatcgcgtcattgcactccagcctaggcgacagtgcgagactccatctcaaaataaataaataaataaataaataaaaataaataaaataaataaaaaataaaaaacaaaaaaagtccttttgaccttacctccaaaatcatgcacatccgcacagctgcttccctggaccaggccctagcaccatgccatggatagccctctccttcgtcttctgttcctccaaagtccattctccacac

SEQ ID NO: 204581 - DNA, 601 bp, Human
ctagatatcatctaggctctgtagagtgggccagagaagacccccagggcccaaccctcccccccaccaccacccccctgccttgtcccagccctgtctcacacccctgcccctaagttatcatacaccaggcttttctctttctggaacaccacaagctgtgtcctgcctctgagcttttgtacacgctagttccccggcctgaaacacttgcgcctcttcctcttgtgcctgccttgtacaaggagtccttcttatccttcagaactcactgtaaattacatgtttcctctatttcacsttcattccagttactctctccccagtgctctgttcatagtgcaaatcacagtctggaatgatcttcactattcttttatggtttgcatctgcctccccaccccccagaatataaacccgttgaggggccaggcgtggtggctcacacatgtaatcccagcactttgggaggctgaggtgggcagatcacctgaggtcagaggttcaagaccagcaaacatggtgaaaccccgtctctactcaaaaatacaaaagttagctgggcatgatggtaggcacctgtaatcccagttactcggga

SEQ ID NO: 204582 - DNA, 601 bp, Human
cagttgggcatggtggctcatgcccatagagtcccagctgcttttgaggctgaggcaggaagattgcttgagcccaggaatttgagggtacagtgagctattattgcacggctgcactccagcctgggcaacatagctagacccccgtctcttttaaaaaaaaaaaaaatgctgggcggtggctcatgcctataatcccaacactttgggacgccagggcgggtggatcacttgaggctaggagttcgagaccagcctaggcaaaagagtgacaccccatctttactaaaaaaacacaaamattccccaggcgcatggtggtgcatgcctgtagtcccagctactcgggaggctgaggcaggagaatcgcttgaacctgggaagtagaggttgcagtgaggtgagatcacgccactgcattccagcctgcgtgacagagcgagactcaaaaaaaaaaaaaaaaaaaaaaaaaaagctgtaacctcaaataggtggtttcttttaaccaccaatttgtccaagccacctaggtagaggagtggcgacagttggctctgaatctttggggtacagccagggaagtctttctggatactgtgat

SEQ ID NO: 204583 - DNA, 601 bp, Human
agtttccagttcccccacatacattttttttttttttgagatggagttttgctcttgttgcccaggctggagtgcagtggtgggatctcggctcactgcaacctccgcctcccaggttcaagcaattctcctgtatcagcctcccaagtagctgcaattacaggcatgcaccaccacgcccagctaattcttatatttttagtagaggtggggtttcgccaggtagtccaggctggtctcaaactcctgacttcaggtgatctgcccgcctcggcctcccaaagtgctgggattacaggcrtgaggcaccatccctggccttttttttggttttgtttttgagacagggtcttgttctgtctcccaggctggagtgcagtggcatgatcatggctcactacagtctcaacctcccaggcttgagcgagcctcccacttcagccttccaagtcgccaggaccacaggtgtgccccaccacacctggctaatttttatagtttttgtagagatggggtttcctcatgttgcccaggctggtctcaaactcctgggctcaagctgtctgcccgcctttgcctcccaaagtgctgggattacagg

SEQ ID NO: 204584 - DNA, 601 bp, Human
tggtttgcatcatctgccatttggtaagagtcacctcctgtgtgctgtgagctatgtactcctgcaagggaggaggccagtttacggagggataggcattgcaccagccttccaagttgctgtcttttttttctttttcttttgaaacagatttaacggaatagtaaacttaatggaatatcaaaccttattatttgtttggtttatattttatttttatttatttatttagtttatactttacttttatttatttatttattttagacggagtttcgctctgtcgccaggctggagtacrgtggtgtgatctcagctcactgcaacctccaactccctggttcaagcgattctcctgcctcagcctcccgagtagctgggattacaggcatgcaccaccatgcccagctaatttttgtatttttagtagagacggggtttcaccatgttgaccagggtggtctcgatctcctgactgcgtgatccgcccgccttggcctcccgaagtgttgggattacaggcatgagccaccgtgcctagctggtttaaactttaaaaacaggtctaaacttcaaatggttcaaagggcatatggcaaac

SEQ ID NO: 204585 - DNA, 601 bp, Human
ttagctggtttccgataacaatcacagattgtttccagtcttggtcagttacaaagatggtagactgtttccagtcttggtcaattacaaacaccactgtagaaaattaccttgacttccattgggctcaaccaattttaattcccaccagctgtggttgaaaacctgtttcccctcaaactcccatcaacaaaacgtttgatcagactttgtgatctttgccaatctgaaaggtaaaaggtgtaacttcaactcacctttctcttatgtggatgaagttaagaggtatttctatttgcattttttttttgagacggagtttcacccttgttgcccaggctggagtgcaatgatgcgatctcagttcactgcaacctccgcctcccaggttcaagcaattctcctgcctcagcctcctgagtagctgggattacaggcatgcaccaccacgcctggctaatttttgtatttttttttttagtagagacggggtttctccatgttggggctggtcttttttttttttttttttaagacagagtctcactctgttgcccaggctggagtgcagtggcacgatctcagctcaccacaacctcca

SEQ ID NO: 204586 - DNA, 601 bp, Human
tgatctttgccaatctgaaaggtaaaaggtgtaacttcaactcacctttctcttatgtggatgaagttaagaggtatttctatttgcattttttttttgagacggagtttcacccttgttgcccaggctggagtgcaatgatgcgatctcagttcactgcaacctccgcctcccaggttcaagcaattctcctgcctcagcctcctgagtagctgggattacaggcatgcaccaccacgcctggctaatttttgtatttttttttttagtagagacggggtttctccatgttggggctggkcttttttttttttttttttaagacagagtctcactctgttgcccaggctggagtgcagtggcacgatctcagctcaccacaacctccacctcccaggttcaagcaattctcctgcctcagcctcctgagtagctgggactacacgtgcatgccaccatgccctgctaattttttttttttttttttttttagtagagatggagtttcactatgttggccaggctggtctcaaactcctgacctcatgatcctcccgccttggtctcccaaagtgctgggattacaggcatgagccaccat

SEQ ID NO: 204587 - DNA, 601 bp, Human
tagtacacccagcacttctatctggtttccaaaacattctcatgggctggatttggtggcttacacctgtaattccagcactttgggaggcccgggcaggagaattgcttgaagtcaggagttcaagaccagcctggacaacatggcgaaaacccatctctacaaaagaaaagaaaaagaaataaagagaaaacaaacattctcatcatcccaaaaggagaacccatacccactagcagtgcttctccatcctcctctgcccccagcccatcacaaccactaatttactttctatctctgyggatttatctatttggaacatttcatgtcaggagttcgagaccagcctggtcaaaatggtgaaacccagtctctactaaaaatacaaaaattagctgggcgtggtggtgtgcgcctggaatcccagctacgcaggaagatgaggcagagagaatcacttgaacctgggaggcagaggttgcagtgagccaagatcgcgccactgcactcctgcctgggtgacagagtgagactccatctcaaacaacaacaacgacaacaaaacaaaacaaaaaagaacctcattcttttttgtggccaa

SEQ ID NO: 204588 - DNA, 601 bp, Human
agaaaagaaaaagaaataaagagaaaacaaacattctcatcatcccaaaaggagaacccatacccactagcagtgcttctccatcctcctctgcccccagcccatcacaaccactaatttactttctatctctgtggatttatctatttggaacatttcatgtcaggagttcgagaccagcctggtcaaaatggtgaaacccagtctctactaaaaatacaaaaattagctgggcgtggtggtgtgcgcctggaatcccagctacgcaggaagatgaggcagagagaatcacttgaacctrggaggcagaggttgcagtgagccaagatcgcgccactgcactcctgcctgggtgacagagtgagactccatctcaaacaacaacaacgacaacaaaacaaaacaaaaaagaacctcattcttttttgtggccaaatgatattccattgtatggacataccgcattttgttgatccattcctcagctgatgggcatttgggttgtttctaccttttggctattgtgaatgatgctgctaagaacatagatatgcatgtacttgttaagtacctgttttcagtgctttggggtatataccta

SEQ ID NO: 204589 - DNA, 601 bp, Human
tgtcaggagttcgagaccagcctggtcaaaatggtgaaacccagtctctactaaaaatacaaaaattagctgggcgtggtggtgtgcgcctggaatcccagctacgcaggaagatgaggcagagagaatcacttgaacctgggaggcagaggttgcagtgagccaagatcgcgccactgcactcctgcctgggtgacagagtgagactccatctcaaacaacaacaacgacaacaaaacaaaacaaaaaagaacctcattcttttttgtggccaaatgatattccattgtatggacatacygcattttgttgatccattcctcagctgatgggcatttgggttgtttctaccttttggctattgtgaatgatgctgctaagaacatagatatgcatgtacttgttaagtacctgttttcagtgctttggggtatatacctagaagagtagaatgctaggtcatatgattttttttttttttttttttttgagatggagtctcactctgtcacccaggctggagtgcagtggtgcaatcttggctcactgcaacctccgcctcccaggttcaagcgattctcctgcctcagtctcctgagta

SEQ ID NO: 204590 - DNA, 601 bp, Human
cctgaagtgctgggataacaggcgtgagccaccgcgcctggcctcatatggtaattctgtttaaatttttgaggaactgccaaactcttgggtattcttgctcatttttataagtgacttagaatcggcacatctagttccaccaaaattttaaatcaggctgggcgcagtggctcacactgtaatcccaggactttaagaggctgaggcaggaggatcacttgagcctaggagttcaacaccagcctgggaaacatagtgagaccttgtctcttcaaaaaataaacaattaggctaggcrcggtggctcatgcctataatcccaacactttgggaggccgaggtgggtggatcacttgaggtcaaaagttcatgtccagcctggcggacatggtgaaaccctgtctctattaaaaatacaaaaaaaaaaaaaaaaaaaaaagttagccgggtgtggtgatgcatgcctgtaatcgcagctactcaggaggctgaggcaagagaatttcttgaacctgggaggtggaggttgcagtgagctgagatggcgccactgcactccagcctgggtgacagagcgagactctgtctccaaaaatat

SEQ ID NO: 204591 - DNA, 601 bp, Human
taagtgacttagaatcggcacatctagttccaccaaaattttaaatcaggctgggcgcagtggctcacactgtaatcccaggactttaagaggctgaggcaggaggatcacttgagcctaggagttcaacaccagcctgggaaacatagtgagaccttgtctcttcaaaaaataaacaattaggctaggcgcggtggctcatgcctataatcccaacactttgggaggccgaggtgggtggatcacttgaggtcaaaagttcatgtccagcctggcggacatggtgaaaccctgtctctaytaaaaatacaaaaaaaaaaaaaaaaaaaaaagttagccgggtgtggtgatgcatgcctgtaatcgcagctactcaggaggctgaggcaagagaatttcttgaacctgggaggtggaggttgcagtgagctgagatggcgccactgcactccagcctgggtgacagagcgagactctgtctccaaaaatataaaaaataaaaaattagctagatgtggtggcacatgcctgtggtctcagctactcgggaggctgaggaaggaggatgacttgaacccagggggtcgaggctgcagtgagc

SEQ ID NO: 204592 - DNA, 601 bp, Human
aaattttaaatcaggctgggcgcagtggctcacactgtaatcccaggactttaagaggctgaggcaggaggatcacttgagcctaggagttcaacaccagcctgggaaacatagtgagaccttgtctcttcaaaaaataaacaattaggctaggcgcggtggctcatgcctataatcccaacactttgggaggccgaggtgggtggatcacttgaggtcaaaagttcatgtccagcctggcggacatggtgaaaccctgtctctattaaaaatacaaaaaaaaaaaaaaaaaaaaaagttwgccgggtgtggtgatgcatgcctgtaatcgcagctactcaggaggctgaggcaagagaatttcttgaacctgggaggtggaggttgcagtgagctgagatggcgccactgcactccagcctgggtgacagagcgagactctgtctccaaaaatataaaaaataaaaaattagctagatgtggtggcacatgcctgtggtctcagctactcgggaggctgaggaaggaggatgacttgaacccagggggtcgaggctgcagtgagctatgattgcacactccactccagcctgagcaacac

SEQ ID NO: 204593 - DNA, 601 bp, Human
ctcagctcactgaaacctccacttcccgggttcaagcgattctcctgcctcagcttcctgagtagctgggattacaggcgcacaccaccacacccggctaatttttgtatttttttagtagagatggggtttcgccatgttggccaggctggtctccaactcctgagctcaggtgatccacctgccttggcctcccaaagtgctgtgattacaggtgtgagccaccacgcccggcccctggccctgcttcttgttcaccagaacaccagtggtggtgggcatgagacagcccccctcctcrgaaatggttgccaacctgtcttctgtccatcccccagtacaaggcagaattggccccaaaaaaggtcagtggacctcagactcctccaaggccaaggtgaaggtgaagcttttcctaatccaggcgacagtgtaaacacacgtgtgatatcgctccccacaccaggagcccaagcagctgctgtgcttggcgaggattgatctgtttattgtacctgttctctcaggccccttgccacctggcttgtagggacaactgagaccaatggtgcttttaaaattatgcagtggaggccgtgag

SEQ ID NO: 204594 - DNA, 601 bp, Human
ttggccggggctgggcatggtggctcatgcctgtaatcccagcagtttgggaggccgaagcgggtagatcacctgaggtcaggagtttcagaccagcctggccaacatgatgaaatcccgtctctactaaaaatacaaaaaaattagctgagcgtggtagcgtgcacctgtagtcccagctactcaggaggttgaggcaggagagtcacttgaacccgggaggtagaggttgcaataagtcgagattgtgccatggcactccagcctggcagcggagtgagactctatcacacacacacamaaaaaaacaattagccaggcatggtggtgggcacctgtaatctcagctacttgggaggttgaggcaggagaattgctgcaacctgggaggcggaggttgcagtgagctgagaacatgccattgcactcctgggccgacaatagcaagactccgtctcaaaaaaaaaaaaaaatttggccgggcaccgcggctcacatctgtatcccagcacttttgaagccaagttgggtggattgtttgaggtcaggagttcgagatcagtctggccaacatggtgaaccccatctctactaaatatac

SEQ ID NO: 204595 - DNA, 601 bp, Human
ggccggggctgggcatggtggctcatgcctgtaatcccagcagtttgggaggccgaagcgggtagatcacctgaggtcaggagtttcagaccagcctggccaacatgatgaaatcccgtctctactaaaaatacaaaaaaattagctgagcgtggtagcgtgcacctgtagtcccagctactcaggaggttgaggcaggagagtcacttgaacccgggaggtagaggttgcaataagtcgagattgtgccatggcactccagcctggcagcggagtgagactctatcacacacacacacamaaaaacaattagccaggcatggtggtgggcacctgtaatctcagctacttgggaggttgaggcaggagaattgctgcaacctgggaggcggaggttgcagtgagctgagaacatgccattgcactcctgggccgacaatagcaagactccgtctcaaaaaaaaaaaaaaatttggccgggcaccgcggctcacatctgtatcccagcacttttgaagccaagttgggtggattgtttgaggtcaggagttcgagatcagtctggccaacatggtgaaccccatctctactaaatatacag

SEQ ID NO: 204596 - DNA, 601 bp, Human
agcgccctgcccaggtctttgcccttgggtgggacagaagctcacgtgttcccaatcctcttcctcccttccctgccggctgaccccagcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggtgaggcggccgtggggccggctgggtcctccctgtggccctggcccttgctccwcttcttgacattagctcatgttatcttggggcagagagggggatagagctggtgggccaggtggccgatctcgagcgatcaccctgctctcctctaagctccgataaagtctccaaagcctctacactgttttccaagcagagcttatagaaaagagtagggccaggcacagtggctcatgcctgtaatcccagcactttgggaggctgaggcaggaggattgagcccaggagttcaagaccagcctgggcaacatagtgagacccctatctctaaaaaaaaaaaaaaaaaaaaaaaaat

SEQ ID NO: 204597 - DNA, 601 bp, Human
tccctgtggccctggcccttgctcctcttcttgacattagctcatgttatcttggggcagagagggggatagagctggtgggccaggtggccgatctcgagcgatcaccctgctctcctctaagctccgataaagtctccaaagcctctacactgttttccaagcagagcttatagaaaagagtagggccaggcacagtggctcatgcctgtaatcccagcactttgggaggctgaggcaggaggattgagcccaggagttcaagaccagcctgggcaacatagtgagacccctatctctaaaaaaaaaaaaaaaaaaaaaaaaattaggctgggtgcagtggctcacacctgtaatcccagcaccttgggaggccgaggcagccggatcacctgaggtcaggggttcaagactatcctggccaaaatggtgaaaccctgtttctactaaaaatacagaaattagctgggtgtagtggtgtgtgcctgtagtcccagctactcaggaggctggggcatgagaattccttgaacccgagaggaggaggctgcagtgagctgagatcatgccactgcactccaacctgggtgaccagagcaag

SEQ ID NO: 204598 - DNA, 601 bp, Human
gggtgcagtggctcacacctgtaatcccagcaccttgggaggccgaggcagccggatcacctgaggtcaggggttcaagactatcctggccaaaatggtgaaaccctgtttctactaaaaatacagaaattagctgggtgtagtggtgtgtgcctgtagtcccagctactcaggaggctggggcatgagaattccttgaacccgagaggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaag

SEQ ID NO: 204599 - DNA, 601 bp, Human
gcatgagaattccttgaacccgagaggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggc

SEQ ID NO: 204600 - DNA, 601 bp, Human
acccgagaggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatccca

SEQ ID NO: 204601 - DNA, 601 bp, Human
gaggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactt

SEQ ID NO: 204602 - DNA, 601 bp, Human
ggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcacttta

SEQ ID NO: 204603 - DNA, 601 bp, Human
aggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttaga

SEQ ID NO: 204604 - DNA, 601 bp, Human
acctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttagaaggctgaggcaggaggatcacttgagccaaggactttgag

SEQ ID NO: 204605 - DNA, 601 bp, Human
tgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttagaaggctgaggcaggaggatcacttgagccaaggactttgagacc

SEQ ID NO: 204606 - DNA, 601 bp, Human
caagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttagaaggctgaggcaggaggatcacttgagccaaggactttgagaccagcctgggcaaca

SEQ ID NO: 204607 - DNA, 601 bp, Human
gactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttagaaggctgaggcaggaggatcacttgagccaaggactttgagaccagcctgggcaacatgg

SEQ ID NO: 204608 - DNA, 601 bp, Human
ctattttctggcggggtggggggggtgggtgggggactgggcggggtggcttctgcctgtaatcccagcactttgggaggtcgaggtgggcagatcacctgaggtcgtgagttcaagaccagcctgtccaacatggcgaaaccctgtctctactaaaaatacaaaacattagccaggcgtgttggcaggcacctgtaatcccagctactcgggaggctgaggcaggagaatctcttgaacccggaaggcggaggttgcagtgagccgagattgcgccactacacaccagcctgggcaacargagcgaaactccatcaaaaaaaaaagtaactattttccaaaacaaaaaatatttactgggaagagtggcattatttcaaatttttgcaaaatccttgaatattggggcttaataggagaaactagattctggcatctttttccatgttccatctttgcaatttgctcttttggttgaactatgttctaaaaatctgatcttacatagatatgtagttagaaaacaaaggagtatttgaatgtccttttcaaatcatggttagtatttctactagccccagaaaaaacctattgtattctg

SEQ ID NO: 204609 - DNA, 601 bp, Human
ctaaaaatacaaaacattagccaggcgtgttggcaggcacctgtaatcccagctactcgggaggctgaggcaggagaatctcttgaacccggaaggcggaggttgcagtgagccgagattgcgccactacacaccagcctgggcaacaagagcgaaactccatcaaaaaaaaaagtaactattttccaaaacaaaaaatatttactgggaagagtggcattatttcaaatttttgcaaaatccttgaatattggggcttaataggagaaactagattctggcatctttttccatgttccawctttgcaatttgctcttttggttgaactatgttctaaaaatctgatcttacatagatatgtagttagaaaacaaaggagtatttgaatgtccttttcaaatcatggttagtatttctactagccccagaaaaaacctattgtattctgaagagaagtaatgaaaatagttttgttattattacaaaaatagttttgagccatagatcccttgaaaaggttttaagggacccactgggatttcctcagaacacactttagcatccaatgagctagattcagtcgatagacatggtttgtgt

SEQ ID NO: 204610 - DNA, 601 bp, Human
atagttttgttattattacaaaaatagttttgagccatagatcccttgaaaaggttttaagggacccactgggatttcctcagaacacactttagcatccaatgagctagattcagtcgatagacatggtttgtgtggtccctctgagcctttaagaaattagactaacaattaaaaatcagaagatggggccaggcgcagtgcttcacccctgtaataccagcactctgggaggccacggcaggcagatcacttgagctcaggagcttgagaccagcctggtcaacatggcgaaaccccstctctactaaaaatacaaaaattagccaggcatggtggcacacacctgtagtcccagctactcaggaggctgaggcaggagagtcacttgaacccgggaggcagaggttgcagtgagtcgagattgtgccactgcactccagcctgggcaatagagtgagactctgtctcaaagaagaagaagaaaaaaaaaggttaattaattaaagaaaataaaaatcaaatgttacagaaaagccagatttctccacattcccttaaaaaatgggaagatctggcatggcatggtggctcacacctg

SEQ ID NO: 204611 - DNA, 601 bp, Human
gctgggaatacaggtgtgagccactctgccgggcccagcatttgcatttcaacccaagttaaaggaatctctttgaagcacagacatccttttgtaaaagaagaaatgctacctcctttccttctatacagattaagagttgctctagctacatttgctacaaatctaacacctttctagaaactgtagccctgcccaggaaggaaacagatgcgatgaggcaatctaggaattttccagaacaacactgccctctgcagatgcagcctgtgtttttccagtaggaacaaaccagccaggmccctggccagggttccagggctgccctccctcccctgtctcccatcctaagtggaaaagttattattggtgccctgcctggtctcactttctccgaggaagctttccgccctatctcagccgcaggatgcccctccgctgagtctcgatagaacttcctggagttttgggtctttatccattgtctctgaattttccctgtcatctgaagccacatttcctctttcccagagggcctcatccccgtctccctgctgtcaacagctgtcaacagcctccttccatccttcagctctcatca

SEQ ID NO: 204612 - DNA, 601 bp, Human
aatctctttgaagcacagacatccttttgtaaaagaagaaatgctacctcctttccttctatacagattaagagttgctctagctacatttgctacaaatctaacacctttctagaaactgtagccctgcccaggaaggaaacagatgcgatgaggcaatctaggaattttccagaacaacactgccctctgcagatgcagcctgtgtttttccagtaggaacaaaccagccaggaccctggccagggttccagggctgccctccctcccctgtctcccatcctaagtggaaaagttattmttggtgccctgcctggtctcactttctccgaggaagctttccgccctatctcagccgcaggatgcccctccgctgagtctcgatagaacttcctggagttttgggtctttatccattgtctctgaattttccctgtcatctgaagccacatttcctctttcccagagggcctcatccccgtctccctgctgtcaacagctgtcaacagcctccttccatccttcagctctcatcagttatgagattcctcccttctgggataccttctttttcttcttattttttttttttttttttttt

SEQ ID NO: 204613 - DNA, 601 bp, Human
atcctaagtggaaaagttattattggtgccctgcctggtctcactttctccgaggaagctttccgccctatctcagccgcaggatgcccctccgctgagtctcgatagaacttcctggagttttgggtctttatccattgtctctgaattttccctgtcatctgaagccacatttcctctttcccagagggcctcatccccgtctccctgctgtcaacagctgtcaacagcctccttccatccttcagctctcatcagttatgagattcctcccttctgggataccttctttttcttcttmttttttttttttttttttttttgagatggagttttgctcttgttgcccaggctggagtgcagtggcacaatctctgctcaccgcaacctctgcctcctgggttcaagcaattctcctgccccagcttcccaagtagctgggattacaggcatgcgccaccatgccgggctaattttgtatttttagtatagatagggtttctccatgttggtcaggctggtctcaaactcccgacctcaggtgatccacctgcctcggcctcccaaagtgctgggagcacaggcgtgggccaccgccccg

SEQ ID NO: 204614 - DNA, 601 bp, Human
cagggttccagggctgccctccctcccctgtctcccatcctaagtggaaaagttattcttggtgccctgcctggtctcaccttctccgaggaagctttctgccctgtctcagccacaggatgcccctctgctgagtctcgatagaacttcctggagttttgggtctttatccattgtctctgaattttccctgtcatctgaagccacatttcctctttcccagagcctggcctcatccccgtctccctgctgtcaacagctgtcaacagcctccttccatccttcagttctcatcagttaygagattcctcccttctaggataccttctttttcttcttcttttttttttttctgagacggagttttgctctgtgacccaggctggagtgcagtggcgcaatcttggctcaccgcaacctctgcctcctgggttcaagcaattctcctgccccagcctctcaagtagctgggattacaggcatgcactaccacgcccagctaattttgtatttttagtagagatggggtttcaccatgttgacaggctggtcttgactcatgacctcaagtaatctgcccgccttggcctcccaaagtgct

SEQ ID NO: 204615 - DNA, 601 bp, Human
tcagcctcccaaagtgctgggattacaggcataagccaccatgcctggccagagataccttctttttggccagtttgctaagtccagttcattcttcagggcttagcacattgtcacctcttccttgaagcctttcttgattgatacaggccaccgtgggctcctccacactcctgcagtgcttaggatggaggtgggagatcagctaggaatgctttggtgacggtgatgtcacatccatcaaacagcagattaaagtagcagagatttccttttcttacataacaagaaatctggaggkgctgtgactggcagttggttcaggagcttaagatctcagtgccaacacctttgcagtgctccctgcctcatgattgcaaggtggctgctgaaagtccagccatcacatcatacatcatagcagaaaggaggaggaaagggaagggagctgtgccagcagatttccactgttctctacccgtggccacctagtaagggagttttcccctctgtagtagttgcaggcaagggaaaacgctagggcataggggtgcatgtgctcctgcctatgcccatggcaggcattaccaatcgatcactg

SEQ ID NO: 204616 - DNA, 601 bp, Human
cagcctcccaaagtgctgggattacaggcataagccaccatgcctggccagagataccttctttttggccagtttgctaagtccagttcattcttcagggcttagcacattgtcacctcttccttgaagcctttcttgattgatacaggccaccgtgggctcctccacactcctgcagtgcttaggatggaggtgggagatcagctaggaatgctttggtgacggtgatgtcacatccatcaaacagcagattaaagtagcagagatttccttttcttacataacaagaaatctggagggactgtgactggcagttggttcaggagcttaagatctcagtgccaacacctttgcagtgctccctgcctcatgattgcaaggtggctgctgaaagtccagccatcacatcatacatcatagcagaaaggaggaggaaagggaagggagctgtgccagcagatttccactgttctctacccgtggccacctagtaagggagttttcccctctgtagtagttgcaggcaagggaaaacgctagggcataggggtgcatgtgctcctgcctatgcccatggcaggcattaccaatcgatcactgc

SEQ ID NO: 204617 - DNA, 601 bp, Human
agtaagggagttttcccctctgtagtagttgcaggcaagggaaaacgctagggcataggggtgcatgtgctcctgcctatgcccatggcaggcattaccaatcgatcactgcactgtttcctgcagaccccaaatgtggcctcagaaccattatcatcatagtactccaggtagatcctgtcagttgattaagaggtgacatgggagataaaacccatttgacatcaggtatttaaaatgtcttgctggccaggggtggtggctcaaacttgtaatcccagcgttttgggaagccaaggcrggaggatcacttgaggccaggagttcaagatgaccctgggcgacatagcaagaccctgtctctattttttaaaaatagataaaatgtcttgcctcatgagatttcttgggtaaatgttttggggttatgtgtgtgtgtgtgtgtgtgttttaattaaacaaatatattgtcttttctttaaaaattttatttattattattttctttgagacagccttgctctgttgcccaggctggagtgcaatggcacgatcttggctcactgcaacctccaccttccaggtccaagtgattctcctg

SEQ ID NO: 204618 - DNA, 601 bp, Human
ttattaagtattaactaacatgatcacaaggtcccacaataggctgtctgtaagctgaggagcaaggagaaccaggccaagtcccaaaactgaagaacatggagtccaatgtttgagggtaggaagtatccagcacgagagaaagatgtaggctgggaggctaagtcagtctcatctttttatatttttctgcctactttatattctagccatgctggcagctaataagatgctgcccaatcagattaagggtgggtgtgcctttcccagcccactgactcaaatgttaatctcctttggraacaccctcacagacacacccaggatcaatactttgcatccttcaatccaatcaagttgacactcagtattaaccatcagagtggtgctaaaaggaaagctcatagtattaaatgcctacatcaaaaagtctgaaagagcacaaatacacaatctgaggtcacacctcacagaactgaagaaacaaaagcaatccaaacccaaacccagcagaagaaaagaaataaagatcagagcagaactaagtgaaattgaaacaaacaaacaagacacaaaagataagtgaaacaaaagcttgtta

SEQ ID NO: 204619 - DNA, 601 bp, Human
agaaatctatatggggtctgtcagggaaggccttccctgaggaagtagcatttaaactaagttcaaaggataagtaacagttaattagatgaatgggcacgaagagggcattctaaacagggaataacatgtgcaaaggtcttgcaataggcttgagcatggcatgtataaagaactgaaagaaggtcaatgtgactggaattcagaggagggagagaagagaaaaattcaataagctgggatagagcaaaaataaaatgtcctgcttttcaaaagaattattaagaaaataaaaaagtcytgtatctataacatataaaaatacaaataaagaacacaactcaacaactaactacccaactttaaaaatgggcaagagacgccaagtgtggtggctcatgcctgtaatcctagcactttgggaggctgaggcaggcagatcacttgaggtcaggggttcgagaccagcctgagcaacatgatgaaaccccatctctactaaaaattagctgggcatggtggtgggctcctgtaatcccagctacttggcaggctgaggcaggagaattgcttgaaccctggaggcagaggttgcagtgag

SEQ ID NO: 204620 - DNA, 601 bp, Human
ctcgcatgggcccagggggcgggggtttgggtggctgccctcagtattgcctgcacaaatatctaccaagtctgcgacgaatagctccagcaactttgcaccgtgttttccagtaagcctaccgacaggcactgtgcagattcaagcagagagaagtccaagcactgaggccgctgctgcaccggccatcctgagaccctagtcgaccttccggcctccgcatccccgccccgcactaggacccctgcagacgatcaggcggcagccggggtgactttcttcctcttttggcaacatggcrggcggagaagctggggtgactctggggcagccgcacctttcgcgtcaggatctcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttat

SEQ ID NO: 204621 - DNA, 601 bp, Human
gctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaawttccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaaccaatcttttccaaaattgtttcactttttgcggagcataatgatctgcaatatgctgctccaggcggtcttattggagttggaacaaaaa

SEQ ID NO: 204622 - DNA, 601 bp, Human
tgtcacttggcgacatcagggcaagtattcccccaagaacctgaccctcacagaggaagttttgcccaagtggccagtccagggactatttattttgtccaggagctcctctttccccagctgtcatacccacaatatggagggtggcttgctggagggcccgggggtcttcatcacatacaactatgggtgggacaggctttgtcagtggaaaggaaaacagtagggttctcccggggaccagaaagcttaacaggagggactgactgaaaacacacagagctctttcttagaagagggsgccctgagcaggagactctcttcctaatatagaaaggaattagggataaaagaggtcgcttgagtgaccccagttcaagcagcattgtggttggaggaaatgggggcatctcaagaaacggagaaaggcttccctctcgggaatttctgccttgattccctaaatccaaagcgagcaaacaggagagagaaaccctgaaaatgggctcggtggtagagagtgaggcgactggtcgtgcaaaaagaaaaaaggccgtctcgggagtccaaacgtcgcggaggaaagtcacaggctctgggg

SEQ ID NO: 204623 - DNA, 601 bp, Human
ataaagttggggggagggggcagaaaataaagggtgtcacttggcgacatcagggcaagtattcccccaagaacctgaccctcacagaggaagttttgcccaagtggccagtccagggactatttattttgtccaggagctcctctttccccagctgtcatacccacaatatggagggtggcttgctggagggcccgggggtcttcatcacatacaactatgggtgggacaggctttgtcagtggaaaggaaaacagtagggttctcccggggaccagaaagcttaacaggagggactgaytgaaaacacacagagctctttcttagaagagggggccctgagcaggagactctcttcctaatatagaaaggaattagggataaaagaggtcgcttgagtgaccccagttcaagcagcattgtggttggaggaaatgggggcatctcaagaaacggagaaaggcttccctctcgggaatttctgccttgattccctaaatccaaagcgagcaaacaggagagagaaaccctgaaaatgggctcggtggtagagagtgaggcgactggtcgtgcaaaaagaaaaaaggccgtctcgggagtc

SEQ ID NO: 204624 - DNA, 601 bp, Human
ctaggattacaggtgactggttttccttcttgtaacctatgtttttctcaattatctttttacttttgaaatccaactaagttcttttaagtattttactaacaggtacactctgtaggtctacaggtaaaaagctattacgttgcaaacattataacgtaatgtaaggtctggattacatgcctaaaaatccaatgattcttggaaccatcaaatctgttaagactgaaaagaataccaatgtttaaatatatctataaaatgcaggtcaaggggctaagaaaattgcaacactagaaaaccaacaaacttaggttgttctaacatacatacacaaatacaggagggacgtttatgggtcacatctgcgaaacattttttcccaaaaagctgaatttttaggcttgcgtgtaatttactagaactgcactgcaggaatcagatgttctgaagctgtgaatgcttactcatgtaggttcctgcctaaccaaaataagtaccagtatgttatatttgtcaccaaaatctaggcagggaagacaaattcagaacactgagagttgccaaatctttaacttttagcttgaagaccataaagctg

SEQ ID NO: 204625 - DNA, 601 bp, Human
cctatgcacaaagatgttaatttcaatcttattcatcagagaaaaatggcaaagaattaaatcaatggcacagccatgggatggcatattacatgagctactttttttttttttgagactgagtttcgctcttgttgcctaggctggagtgcaatggcgcaatctcagctcaccgcaacctccacctcccaggttcaagcgaattgattctcctgcctcaacctcccaagtagctgggattacaggcatgcgccaccacgcccagctaattttgtattttttagtagagatggggtttctycacgttagtcaagcaggtctcaaactcctgacctcaggtgatctgcccacctcagcctcccaaagtgctggatgtataggcatgagccactgtgcccagcctagtcattatttttttttttttttgagacgaagtctcactctgtggcccaggctggagcacagtggcgctatctctgctcactgcaagctccgcctcccgggttcacaccattctcctgcctcagcctcctgagtagctgggactacaggcgcccgccaccacgcccggctaatttttttttttttgtatttttagtag

SEQ ID NO: 204626 - DNA, 601 bp, Human
aattcaaactacgtgttaaacatggctgggcacagcggcttacatctgtaatcccagcactttgggaggccaaggccagaggatcacttaagcccaggaatttgagaccagcctggccaacagtgagacctcatctctacaaaaaaaataaaattagccaggcaagtggccacgactgcagtgagctgagatcacaccatgaactctcatctgggcaacagagtgaaatcctgtctcaaaacacacacgtgcgcatgcgctcaaaacacacacacacacacacacacacacacacacacaagcacgcacgcacgcgcatgcgcaaaccctaccacatgatctagcttagccaagagaaaaaaaagcgtatatccatacaatgttcatagcaactttactggtaatagcccaaaactggaaataacccaaatgccaccaagcattaagaggtgaatgcataaacaaattgtggtatatccacataatagaatactactcagcaataaaaaaaaaatgaactaaataacatgggtgaatctcagaattataagtgaaagaacccacacaaaaagagtatgtactgaatgattccgcttatata

SEQ ID NO: 204627 - DNA, 601 bp, Human
taaattcaaactacgtgttaaacatggctgggcacagcggcttacatctgtaatcccagcactttgggaggccaaggccagaggatcacttaagcccaggaatttgagaccagcctggccaacagtgagacctcatctctacaaaaaaaataaaattagccaggcaagtggccacgactgcagtgagctgagatcacaccatgaactctcatctgggcaacagagtgaaatcctgtctcaaaacacacacgtgcgcatgcgctcaaaacacacacacacacacacacacacacacacacagacgcacgcacgcacgcgcatgcgcaaaccctaccacatgatctagcttagccaagagaaaaaaaagcgtatatccatacaatgttcatagcaactttactggtaatagcccaaaactggaaataacccaaatgccaccaagcattaagaggtgaatgcataaacaaattgtggtatatccacataatagaatactactcagcaataaaaaaaaaatgaactaaataacatgggtgaatctcagaattataagtgaaagaacccacacaaaaagagtatgtactgaatgattccgcttata

SEQ ID NO: 204628 - DNA, 601 bp, Human
acgcccggctaattttttgtattttagtagagacagggtttcaccatgttgcccaggctggttggtctcgaactcctgagttcaagcaatgcccggctaattttttgtattttagtagagacagggtttcactatgttgcccaggctggttggtctcgaactcccgagttcaagcaatctgcccacctcagcctcccaaagtgctaggattacaggcatgagccactgcgtctggccaagacactggaatttatatgctcagggcaccattcctgtgtctgaataccaaaacagtctactyaccaaacatactatcattgctccaaactaaaacaggtacaagccaggtcacctttttgttagccaaactaaaagttccagctgtcagtaatattaattttttttgagacagggtctcactctgttgtccaggctggagtgcagtggcataatgatggcttgctgcaccctcaatctcctgagctcaagcactcctcccaaagtggtgagattacaagcatgagccactgaatccagctttaattttttttttagcaacacacatgtaaatgtccataagataaattgtttataatttatc

SEQ ID NO: 204629 - DNA, 601 bp, Human
aaacaaacaaacaacaacaacaaaaaaaacacacagacttgaaaacatacaatttatgggccaggtgtggtggtggctcgcgcctgtagtcccagcactctgggaggctgaggcggatggatcacgaggtcaggagatcgagaccatcctggccaacacagtgaaaccccgtctctacaaaaatacaaaaaaattagccgggcatggtggcaggcacctgtagccccagctactcggaaggctgaggcaggagaatggcgtgaacccaggaggcagagcttgcagtgagccgagatcacayaactgcactccggcctgggcaacagagtgagactccatctcaaaacaaaaaaaagaaaaaagaaaaaacatacaatttatgaaaatgaaatgaaattacagtctttatgaaccacaaatacagtttttcagatatatcatggtttatatgttatatataaaactcttaactaaatctcaaacaagggaaaagtcacattaattactccaagagaaagaactggttactaactactttaatgcaggagctcgtggataaaaaagatgagtggataaaaaagcaagtgagtattcacaacag

SEQ ID NO: 204630 - DNA, 601 bp, Human
aaaaaaaaaaaaaaaaaaagctgaaataaaaacacatacaccaaaaatcatcaaggttttctcatttaaaggagtaatttcaactgcttagaaaattctgaagtggaaaatatatataaaaaaataaaataaaaattttaaaaaacagtcagggtggctcaccctgtaatcccagcactttgggaggccaaggtagccagatcacttgaggtcaggagttcaaaaacagacaggacaagaccccatttctacaaaaagtatatatatgtgtgtgtgtatatatatgtgtatatatatataagtgtgtgtgtgtatatatatgtgtatatatgtgtgtgtatatatatgtgtgtgtatatgtgtgtgtgtgtgtgtatatatatatatgcaccacaaaatagaggtgaaaggtaaaaataaacatatgtatatatagaggtatacatagaagcagaaatatatatagataaatatataacttttaaaaataaatttaaggctgggcatggtggctcacatctgtaatcccaccattatgggaggctgaggtgggcagatcacgaggtcaggagttcaagaccaacatggtgaaaccctgtat

SEQ ID NO: 204631 - DNA, 601 bp, Human
tgtaatcccaatactttgggaggctgaggcaggcggatcatgaggtctggggttcaagaccatcctggccaacacggtgaaaccctgtgcctactaaaaatacaaaaaagagccaggcatggtgacacgtgcctgtagtccacttgggaggctgaggcaggagaagtgcttcaactccagcctggcgacagagcaagtctctgtctcaaaaaaacaaaaataaaaacaaaaaacaaacacaacttatggccaggcacggtggctcatgcctgtaatcccagcactttgggaggccaaggcrggtggatcatttgaggtcaggagttcaagaccagcctcgccaacatggtgaaacctcgtctctactaaaaatacaaaaattagccgggtgtggtggcacacacctgtaatcccagctactcagaagcctgaggcagaagaattgcttgaactcgggaggtggaggttgcagtgagccgagattgcaccaatgcactccagcctgcgcgacaaagcgagactccgtctcaaaaataaataaataaataaaaacaaatattttgtcttttcaaataactagaagagtggattttggatgttc

SEQ ID NO: 204632 - DNA, 601 bp, Human
acaatttattgtagctgagcgcagtggctcacacctgtaattccagcactttgggaggcgggtcagttgagcccaggagtttaaaaccaacctgggcaacatggcgaaataccatctcaaaattaaaaaaaaaaaaaaaaaaaaatttggctgggctcagtggctcacgcctgtaatcccaatactttgggaggctgaggcaggcggatcatgaggtctggggttcaagaccatcctggccaacacggtgaaaccctgtgcctactaaaaatacaaaaaagagccaggcatggtgacacgygcctgtagtccacttgggaggctgaggcaggagaagtgcttcaactccagcctggcgacagagcaagtctctgtctcaaaaaaacaaaaataaaaacaaaaaacaaacacaacttatggccaggcacggtggctcatgcctgtaatcccagcactttgggaggccaaggcaggtggatcatttgaggtcaggagttcaagaccagcctcgccaacatggtgaaacctcgtctctactaaaaatacaaaaattagccgggtgtggtggcacacacctgtaatcccagctactcagaagcct

SEQ ID NO: 204633 - DNA, 601 bp, Human
acgtgggagctaaaaaagttaatttcatagaaatggagcagaatagtggttactagagtctggtggggaggtagccagagatcggttaacaaataccaaattacagatagataagagaaataagtcttagtgtgcattcgaaggtgaccataattaacaatttattgtagctgagcgcagtggctcacacctgtaattccagcactttgggaggcgggtcagttgagcccaggagtttaaaaccaacctgggcaacatggcgaaataccatctcaaaattaaaaaaaaaaaaaaaaaaaattttggctgggctcagtggctcacgcctgtaatcccaatactttgggaggctgaggcaggcggatcatgaggtctggggttcaagaccatcctggccaacacggtgaaaccctgtgcctactaaaaatacaaaaaagagccaggcatggtgacacgtgcctgtagtccacttgggaggctgaggcaggagaagtgcttcaactccagcctggcgacagagcaagtctctgtctcaaaaaaacaaaaataaaaacaaaaaacaaacacaacttatggccaggcacggtggctcatgcctgta

SEQ ID NO: 204634 - DNA, 601 bp, Human
acaacaaaaaaatgtgggcaacaaataaatggataaaatgtggtatgtaatacactatatatgaatactattcagccataaaaaaattaaaaccacatcttataattcccagcatcatggatgagtttaggggacattacgttaagtaaaataaagcaggcacgcaaagacatgtatcgcatattctcactcatacgtgggagctaaaaaagttaatttcatagaaatggagcagaatagtggttactagagtctggtggggaggtagccagagatcggttaacaaataccaaattacagrtagataagagaaataagtcttagtgtgcattcgaaggtgaccataattaacaatttattgtagctgagcgcagtggctcacacctgtaattccagcactttgggaggcgggtcagttgagcccaggagtttaaaaccaacctgggcaacatggcgaaataccatctcaaaattaaaaaaaaaaaaaaaaaaaaatttggctgggctcagtggctcacgcctgtaatcccaatactttgggaggctgaggcaggcggatcatgaggtctggggttcaagaccatcctggccaacacggtga

SEQ ID NO: 204635 - DNA, 601 bp, Human
ggttgcagagtgtcagatcataaaaagctcagccccttctccatacagcagcccacataatcttggtcacaaacgccacgctctagtacatactagtacatatgtacttaacagtaacttatttacaacctgattctttaatcaagataacctaccaaccgcctcatacctcatgagtgccctcttgctcatctatctcctgtctctatgacattctgcttccaccaggaagccttctctgatagactcaactctgtgcttttccaaggccctattctcctttttaaaacgtacttctaargatgcctaggctttttattcatacactatcttcataactccatgtaatggtcctattatttttatacagaataaaacagagacactaaaatgttaataatagaattcagtaacttttttaagaaacctattagaaatttaaaaatgtgggcaacttcgccaggtgcggtggctcatgcctgtaatcccagcactttgagaggcagaggggggtggatcacaaggtcaggaattcaagaccagcctggccaagatcgtgaaaccccgtctctactaaaaatacaaaaattagccgggcgtg

SEQ ID NO: 204636 - DNA, 601 bp, Human
aagtaatattgaatcaaaatgtatatttatataaacatacaaaatactacatacatacatatatgagaaaataaacatgaatggtatgatgacaattcaagaagacagggagggaagcggaatcaggaaagacatcacaggaggctttagtgtaacttcaggtgttattacctcaaaaaaaagttctgaagacaatgttaaaatctgacaactgggaaatggatgctgttcattattttattccacatatttgttgtggtgcttaaaatattttgtcattgaaaaaaatgtaataaacaawtgactagaaaaagtcaaaaaaaaaaaaaaaaaaaaagcaatctttaaaatgtcctggtgttggccgggcacagtggctcactgtttaggtggtcaaagtgggaggatcacttgaggccaggagtttgagaacaacctggacaacctatcaagactctctgcctctaaaaaaaaaagtcctggtgtttatagttccaaatcaatatatattacacgtgatttttttttttaaagctaacattggtgtgcttatgtgttagatactgtgctaaccactactacacaatttcacttacttggt

SEQ ID NO: 204637 - DNA, 601 bp, Human
atttcttactgtgtctagtgaacaaaaaaggcttgaaaaacactatcccagaaaaacacatatgtgctcaaaaagacactcataaatgttaattatgacactgtatataacggtgaaaaactggaaataacctaaatgtgcattaacaaaatggaaaaaatatggtacacatataactcaatataaatgaactggaaacaaatgaagtaaagctactagaatacttctaataatatcaataaatcttaaaagtaatattgaatcaaaatgtatatttatataaacatacaaaatactacawacatacatatatgagaaaataaacatgaatggtatgatgacaattcaagaagacagggagggaagcggaatcaggaaagacatcacaggaggctttagtgtaacttcaggtgttattacctcaaaaaaaagttctgaagacaatgttaaaatctgacaactgggaaatggatgctgttcattattttattccacatatttgttgtggtgcttaaaatattttgtcattgaaaaaaatgtaataaacaaatgactagaaaaagtcaaaaaaaaaaaaaaaaaaaaagcaatctttaaaatg

SEQ ID NO: 204638 - DNA, 601 bp, Human
gataccatttcacatccatcagataggcaaaatgttagaaagctggataaatgatggtgtggatatgaataaacaggaactctcatatgttgctgatgggaatgtgagtttggtaaaattactttgaagagtgatatttttcatctctcgccaagctgaaaatgagcactgtcaaagcagcaattctgcttcaggttacatacattagactattatttgtcaaatattgtcctgatcagcttatttttaaatgaagggatatttattcatatctcaagtatgcatctctcacattgtatgygtaaatattttttcagggtaaatattttataaaactataatttctattacatgtaaatatttatgcatatatatatgaacattatgcaaataaacacacacatattttgggtatcaatgtaaaatacatttcttactgtgtctagtgaacaaaaaaggcttgaaaaacactatcccagaaaaacacatatgtgctcaaaaagacactcataaatgttaattatgacactgtatataacggtgaaaaactggaaataacctaaatgtgcattaacaaaatggaaaaaatatggtacacata

SEQ ID NO: 204639 - DNA, 601 bp, Human
agctccctagaataggaaagccatgtctcacctctcttgttaccatctttactgctttgcacagggtctgacagaaagaaggcaccaaaaatatttgactagaaaataaactgagaaaacactgggataccatttcacatccatcagataggcaaaatgttagaaagctggataaatgatggtgtggatatgaataaacaggaactctcatatgttgctgatgggaatgtgagtttggtaaaattactttgaagagtgatatttttcatctctcgccaagctgaaaatgagcactgtcaaagcagcaattctgcttcaggttacatacattagactattatttgtcaaatattgtcctgatcagcttatttttaaatgaagggatatttattcatatctcaagtatgcatctctcacattgtatgcgtaaatattttttcagggtaaatattttataaaactataatttctattacatgtaaatatttatgcatatatatatgaacattatgcaaataaacacacacatattttgggtatcaatgtaaaatacatttcttactgtgtctagtgaacaaaaaaggcttgaaaaacactatcc

SEQ ID NO: 204640 - DNA, 601 bp, Human
tctgaaaatgcccactcatctttcaagaccaaggtcaaacttcatctcttggaacagccccatttccctaggcaggctgcacattgcaccccgttgtgtgtccctttgccactcactgggagacaaagttcatctctctcctagaatgcaagctccctagaataggaaagccatgtctcacctctcttgttaccatctttactgctttgcacagggtctgacagaaagaaggcaccaaaaatatttgactagaaaataaactgagaaaacactgggataccatttcacatccatcagatargcaaaatgttagaaagctggataaatgatggtgtggatatgaataaacaggaactctcatatgttgctgatgggaatgtgagtttggtaaaattactttgaagagtgatatttttcatctctcgccaagctgaaaatgagcactgtcaaagcagcaattctgcttcaggttacatacattagactattatttgtcaaatattgtcctgatcagcttatttttaaatgaagggatatttattcatatctcaagtatgcatctctcacattgtatgcgtaaatattttttcagggtaaatat

SEQ ID NO: 204641 - DNA, 601 bp, Human
agaccctttctctatgtatatgtttaacatgtaagaaagaaaagaaagaaggctgtgcactgtggttcttgcctgtgatcccagcactttgggaggttgaggcaggtagatcacttgagcccgggagtttgaaatcagcctgggcaacatggtgaaaccccatctctacaaaaaaatacaaaatttagccaggtgtggtagtatacgcctatagtaccagctactgaggtggctgaggtagaaggatcacttgagcccgagaggtcgaggctgcagtgagctatgattgtgtcactgcackcaagcctgggtaactgagcaagaccttgtctcaaaaacaaaaacaaagtaaaaaaaaaaaaaaaaaaaaagcaccaaaaaacaaggcacatggatgaaaggaaatgtgtcatatgctaggaaagaatagaaaatgaccaactctagttcaaaggaaatataataatttctattatctacctgtttcaaaaagactatagtaaacagctaagctaatgcgtttgaaactgaaattaagacaaaaacttgattgaccatcacgtttaataccagaatccattcctagacttgtaaaaacaaa

SEQ ID NO: 204642 - DNA, 601 bp, Human
ggagcatgggctggatgcttgaggccaggagctcacaaccagcctatacaatgtagaccctttctctatgtatatgtttaacatgtaagaaagaaaagaaagaaggctgtgcactgtggttcttgcctgtgatcccagcactttgggaggttgaggcaggtagatcacttgagcccgggagtttgaaatcagcctgggcaacatggtgaaaccccatctctacaaaaaaatacaaaatttagccaggtgtggtagtatacgcctatagtaccagctactgaggtggctgaggtagaaggawcacttgagcccgagaggtcgaggctgcagtgagctatgattgtgtcactgcactcaagcctgggtaactgagcaagaccttgtctcaaaaacaaaaacaaagtaaaaaaaaaaaaaaaaaaaaagcaccaaaaaacaaggcacatggatgaaaggaaatgtgtcatatgctaggaaagaatagaaaatgaccaactctagttcaaaggaaatataataatttctattatctacctgtttcaaaaagactatagtaaacagctaagctaatgcgtttgaaactgaaattaagacaaaaact

SEQ ID NO: 204643 - DNA, 601 bp, Human
caaaaaatccaaattcttttttttttttttttgagacagtcttgctctgtcacccaggatggagtgcagcaacacaatcaagactcactgcgacctctgcctcctgggttcaaatgattctcatgctcaacctcctgagtagctgggattacaggcatgtgccaccacacccagctaatttttgtatttttattaaaatagagacagggttttgccatgttggccaggctcaagtgcccggccccaaaatccaaattcttaaaattaccaacctgtacaaagctatacctattcatatttsacaataaaaaacacctgtgaagaccatttgttgtcccactgaaaactaaggagcatgggctggatgcttgaggccaggagctcacaaccagcctatacaatgtagaccctttctctatgtatatgtttaacatgtaagaaagaaaagaaagaaggctgtgcactgtggttcttgcctgtgatcccagcactttgggaggttgaggcaggtagatcacttgagcccgggagtttgaaatcagcctgggcaacatggtgaaaccccatctctacaaaaaaatacaaaatttagccaggtgtg

SEQ ID NO: 204644 - DNA, 601 bp, Human
tgcggctgggagcggtggctcacacctgtaattccagcactttgggaggccaagaagggggatcaagaggttaagagatcaagaccatcctggctaacacggtgaaaccccatctctaccaaaaatacaaaaaattagccaggagtggtggcgggcgcctgtagtcccagctactctggaggctgaggcaggagaatggcgtgaacctgggaggcggagcttgcagtgagccgagatcacaccactgcacttcagcctgggcgacacagcaagattccgtctccaaaaaaaaaaaaaaaaacacagctgggcatggtggcaggtgcctgtagtcccagctactggcaggagaattgcttgaacctgggaggtggaagttgcagtgagccgagatcgtgccactgcactccggcctggcaacaaagcgagactccgtctcaaacaaacaaacaaaaagttccatttgctgggtctcacatgttgcctacaaattcgagattatgctgtttttcattttattttagaacagtcaccttgtatccaactgatccagcccacttttactgccaaggtgttaacatgcattacatttgctgaagac

SEQ ID NO: 204645 - DNA, 601 bp, Human
ccacttaaaaaaaaaaaagaagccatttatcacactcaagttctaacaattaaaaaaaaaaaaaagcctaccaaaaatcaaatcccaaaccacagccatcctctccagaactttgcaacagtctagttcacatctacaagccttacttttgtttggaaagctagggggaaggaaagcagcctgttttagatttcatttctagggaaatagaaatagacgcaaagcctcaaggttacacagtacacacagagaacatcctgtccactagcctaaacacactctaagcatgtacacggctaayggccaaaccacctgcaaaagttccatttgcggctgggagcggtggctcacacctgtaattccagcactttgggaggccaagaagggggatcaagaggttaagagatcaagaccatcctggctaacacggtgaaaccccatctctaccaaaaatacaaaaaattagccaggagtggtggcgggcgcctgtagtcccagctactctggaggctgaggcaggagaatggcgtgaacctgggaggcggagcttgcagtgagccgagatcacaccactgcacttcagcctgggcgacacagcaag

SEQ ID NO: 204646 - DNA, 601 bp, Human
acctgtagtcccagctacttgggaggctgaggcaggagaatggcatgaacctgggaggcggagtttgcagtgagccgagattgcgccactgcactccagcctgggtgacagagcgagactctgtctcaaaaaaataaataaatactaaatactactactggtactttcaggcaggcaacacccttaacctctaaacagaacgaactattttccccacatatggttttcagagcactaggaagaaacactgaaacagaaaggcatctgtttagaagcagaactttaactccttgtaaaacarcctgcccgtacctgtggccaaagcaaaagcaaacgggctaagtggcccagaccctcctaactctgcctgtctttcaagagaactcctaccatccccagcatgcagttgcttttgagctccctttgtatctcaaaatccataaaaatgttgagtaccacagatcgttctttcaatcatcagttcagaatacagaaacagaccaaaggcaatgcaaagacaatctataatttaaaaattccttgacctctatctgcctcgtaagtccatctagctaaaatgtacatttcatataaagttcaa

SEQ ID NO: 204647 - DNA, 601 bp, Human
gctttaaaccatgggtgctaaagagcaactaaggagttttaggcaagaagtagcataatcagatgtacaaaaaacagtatcatgcctgtaatcccagcactttggaaggccgaggaaggctgattgtctgaggtctggagttcaagaccagcctggacaacacggtgaaaccccgtctctactaaaaatacaaaaattagccaggtgtggtggtgggcacctataatcccagctactcggaaggctgaggcaggagaatcacttgaacccgggaagcggaggttgcagtgagcagagagcrcaccaccgtactccagcctgggtgacagagtaagattccatctcaaaaaacaaaaacaaaaacaaaacaggatcactctggcagccaagatgaaaggcagactggaaggagacagactagatgcagggagccctgaagttgtgagattatctccaacagtccaggtaaggtcccgaggccctgaatcaaacagtggtggtcgcaatggagggcagggttgggggagagaataaagaggcagaacaggtcaggcatggtgactcatgcctgtaatcccagcactttgggaggccaaggcgc

SEQ ID NO: 204648 - DNA, 601 bp, Human
tctatctcaaaaaaaaaacaaaaacaaaaacaaaaaggccaaaagagaaagggactctgtagaagagttaggaagtgtcccttgagaaggctaggggaggggagaggcatacagcacagcattgtatctttgaccgatggtaggaaggcactacttctctatcaaactgacttttaaaccaagactccatcaaaccgatttttataccaaggttaggctttaaaccatgggtgctaaagagcaactaaggagttttaggcaagaagtagcataatcagatgtacaaaaaacagtatcatgmctgtaatcccagcactttggaaggccgaggaaggctgattgtctgaggtctggagttcaagaccagcctggacaacacggtgaaaccccgtctctactaaaaatacaaaaattagccaggtgtggtggtgggcacctataatcccagctactcggaaggctgaggcaggagaatcacttgaacccgggaagcggaggttgcagtgagcagagagcgcaccaccgtactccagcctgggtgacagagtaagattccatctcaaaaaacaaaaacaaaaacaaaacaggatcactctggcag

SEQ ID NO: 204649 - DNA, 601 bp, Human
gcaagactctatctcaaaaaaaaaacaaaaacaaaaacaaaaaggccaaaagagaaagggactctgtagaagagttaggaagtgtcccttgagaaggctaggggaggggagaggcatacagcacagcattgtatctttgaccgatggtaggaaggcactacttctctatcaaactgacttttaaaccaagactccatcaaaccgatttttataccaaggttaggctttaaaccatgggtgctaaagagcaactaaggagttttaggcaagaagtagcataatcagatgtacaaaaaacagkatcatgcctgtaatcccagcactttggaaggccgaggaaggctgattgtctgaggtctggagttcaagaccagcctggacaacacggtgaaaccccgtctctactaaaaatacaaaaattagccaggtgtggtggtgggcacctataatcccagctactcggaaggctgaggcaggagaatcacttgaacccgggaagcggaggttgcagtgagcagagagcgcaccaccgtactccagcctgggtgacagagtaagattccatctcaaaaaacaaaaacaaaaacaaaacaggatcact

SEQ ID NO: 204650 - DNA, 601 bp, Human
aagtgcattcagagttttaattgagacactaaaaccatcatttgaacctcattgcaactggagcccctctctctcagagaaggaatacaaaacacaggagaaagatcataaagaactatgtaatataaggagcagggagaaaatgtcaggtgggaaaaatggccggaaatgggaagaagaaacatgtacaagaatcaccaggagagtgacattccccgccccactgatacctagagaggggcaggcagggggtaggtattcatcagacatgcacactttgatgaagcaccccgtgaatttstgacctacacctcaaagaaccacagctccaaggagtgagctgcaaggccatgaaaaacatacaaggggacggttcagagccccaggtttgctcactgagcattctttctaccagactccagtccaagggtcttttccttttgcttctaattgccctggaagagtagaaataagaacccttcaaaaagagaaaaatgggccgggagtggtggctcacgcctgtaatcttagcactttgggaggctgaggtgggaggatcacttgaccctaggagttcaagacctgcctagacaacataatg

SEQ ID NO: 204651 - DNA, 601 bp, Human
gagtccttaactaacagccttaagttttgtttcaaaagttcttaagtccattgcgtagaactcagaatgtaacttcctacacacaaaagccaatttaactcacttttatctgaagtacactatttaactctggaatattagccatcatctataccaatgcttttactaaaaaaagtaagtgcattcagagttttaattgagacactaaaaccatcatttgaacctcattgcaactggagcccctctctctcagagaaggaatacaaaacacaggagaaagatcataaagaactatgtaatrtaaggagcagggagaaaatgtcaggtgggaaaaatggccggaaatgggaagaagaaacatgtacaagaatcaccaggagagtgacattccccgccccactgatacctagagaggggcaggcagggggtaggtattcatcagacatgcacactttgatgaagcaccccgtgaatttctgacctacacctcaaagaaccacagctccaaggagtgagctgcaaggccatgaaaaacatacaaggggacggttcagagccccaggtttgctcactgagcattctttctaccagactccagtcc

SEQ ID NO: 204652 - DNA, 601 bp, Human
cagtggcgccaccttggctcactgcaacctccacctcccggttcaagcgattcttgtgcctcagcctcctgagtagctgggattacaggtgtgtgccaccacatgcggctaatttttgtatttttagtagaggcagggtttcaccatgttggccaggctggtctcgaactcctggcctcatgtgatccacccacatcagcctcccaaagtgctgggattacagttgtgagtcacgcgcccagccctgagtaaagccagtatttaagagaagaggaacctacaaggtatcctgagaaacagwtaggcatctagaattaagttaagtatttgttaggttatcatttaatgtctgctttcaacaagtatgcaatgtcttacagagaaaattcaagttttaaaaagaaaaaaaaatttgcttatagtaaagttactgaaaaagaaaaagttctttcagaataccgtaacatggcttcctgggacaggaaggaaaccaatgagatacaccctcctgacctcttaccagtacttcaaaaagtgcaataaagctggttgagagaaacaaagaagtttctttggagacctactttaaacgcttaatccg

SEQ ID NO: 204653 - DNA, 601 bp, Human
gccttaagcaatcctcttgccttggccttccaaagtgctgggattaacagtgtgagccactgcaccaggcctttatggtgtgtctaaatggcacttccttagagacctttccgatcacctgaagtacatgcccaacagaccatcccaattattctctacctcattctattgtctatttccttgtaggttttatcatgagtactattttgtctttttatatcctccctcacctcgaacgaaattcgacttccaagagggcaagaaccttatttgcctttattcctgacatgtagctgagtgmctagcctcggctacgtgtcagtggatgctcaacagaaactggttaaatgaatagtgtgagtaggtgccaggcactacgctagacagtaggatctggaaataagagagcatctgccctctgaaagctccaagtttagtggggaaatgaacaatcaataaactaccaaagaggcagttaagagtgatatgagggttactcagcagtgctgaagaggcacactgaaggtgctcctgtcctaatccaggaggtggggaagccaaaggtgttttcaagaggtggtggatgctggctaaatgcaat

SEQ ID NO: 204654 - DNA, 601 bp, Human
aaagggctgtatacctaattttgacatataatgcttaaatatccttcaaaaaggttgcatccagttactttctaactaccatcacctaagcagacctgtttccctcatgctctcaccaataccagtattaaagcttttatagtaaaataaagttcacctttaaacaccacctcaattgccaaacgcagctcaaattgtccagtgcttttttttctctcatgctgttcaccaatccaacagagccctggctaggtgacccatggggaaaagcatgcttttcacagggattcgctctactgtyccttcttgcctctttaacacaacacgtgcatgtgctcaggattcacgaacaaaaacttactaagatatgaagcacctttcatcaactatctcaaagagaaggctaatcaattaaatctcacctaacgtgtgagacaggttaactccagaacctgatcagaaaaaaacaaaaacaaggacagagtttagtctgatacggcatcacttaatcaaacaacaaggagtagtattttacctacatctcaaacacttaaaaagtatttgtacttctaaatctgtgcccccacagggctggacacca

SEQ ID NO: 204655 - DNA, 601 bp, Human
cccacctcacccaccccagtagcttggattacaggcatgcatcagcacatccggctcattttttattttttgtatagatgaggtctccttatgttgcccagactagtctcaatctactggtctcgagtgatccttctacctcaggctcccaaagtgctgggattataggtgtgagtcaccttgcctggcccttttctgtttttccattttaaatacagtttttactctaacttgacatatagactgcaatgccactcaatgaagatagcatttagctaagtcagtgcataaaaatctctaytcacagaccttttaatcaggcatttatgaatcattcacagtaagcagttaaattttacgaggaaatattttctttggcattcttcatagtgacaaatagttacctctgtagagtggtgggtgataattaataaataccaagctgcggtacccattcagcagataaagatgatcaaagtgtgaataatggatcataaaaaatgtgcaggaagagatgccagatatgccatcatccccttcctcttacattacattcagcgcaccccaaagtcatggagccacttactcgaagacccaggtc

SEQ ID NO: 204656 - DNA, 601 bp, Human
cagctcacggcagcctcgaccctcccaggttcaaatgatcctcccacctcacccaccccagtagcttggattacaggcatgcatcagcacatccggctcattttttattttttgtatagatgaggtctccttatgttgcccagactagtctcaatctactggtctcgagtgatccttctacctcaggctcccaaagtgctgggattataggtgtgagtcaccttgcctggcccttttctgtttttccattttaaatacagtttttactctaacttgacatatagactgcaatgccactcartgaagatagcatttagctaagtcagtgcataaaaatctctattcacagaccttttaatcaggcatttatgaatcattcacagtaagcagttaaattttacgaggaaatattttctttggcattcttcatagtgacaaatagttacctctgtagagtggtgggtgataattaataaataccaagctgcggtacccattcagcagataaagatgatcaaagtgtgaataatggatcataaaaaatgtgcaggaagagatgccagatatgccatcatccccttcctcttacattacattcagc

SEQ ID NO: 204657 - DNA, 601 bp, Human
aagacctagacctgcaaattctaagggtggaggggagacgaaaccattgcgcacatgagaaaaacatgcaggaagaaccttgtcattccaaaggcagaacctacctaatcacaggaggctggcaagacaaggaaaacaaatcacaaccttaaaaatgacaatagcaactcaccttgaaaacttccaagtcataggcaacatataatttccccgtaaatgatacaaagacatacaaataatcaggtggccctctgcaaaatcctaatgaaaacatctatttatttcttccccccaactcccyctccccaaaatatctatttaaaaacatcctactaggccaggcacggtggctcacacctgtaatcgcagcactttgggaggtcaaggcgggtggatcacgaggtcaggagatcgagaccatcctggctaacacagtgaaaccccgtctctactaaaaatacaaaaaaattagccgggtgcctgtagtcccaactacttgggaggctgaggcaggagaatggcgtggagcttgcagtgagttgagatcgcgccactgcactccagcctgggcaacaaagcaagactctgtctcagaaaaaaa

SEQ ID NO: 204658 - DNA, 601 bp, Human
gacacttcagagatattaacaagtccacaatgaaattccaaatctagaaaaattgttttaaaaactttttggaaaacttttagaaggtaggaccttaaaagacatctggtacttaattaaaatccactttttctgctctcaggaaattataaaataattagacaacaaaaatctttcctggttaactgtaggcctggaggcaaacaatgagctgtgcatctgacatgctgtgcagaagtcccaagtggcatttagttatggctgtcacacagtctctagcacctgtcacatgggggctatrgcatgaagggaagcacaggcggaagacctagacctgcaaattctaagggtggaggggagacgaaaccattgcgcacatgagaaaaacatgcaggaagaaccttgtcattccaaaggcagaacctacctaatcacaggaggctggcaagacaaggaaaacaaatcacaaccttaaaaatgacaatagcaactcaccttgaaaacttccaagtcataggcaacatataatttccccgtaaatgatacaaagacatacaaataatcaggtggccctctgcaaaatcctaatgaaaacatctat

SEQ ID NO: 204659 - DNA, 601 bp, Human
tcccatcttttttttttttttttttgagacggagtttttgctcttgttgcccaagctggagtgcaatggcatgatcttggcccactgcaacctccacctcccgggttcaagtgattctcctgcctcagcctcccgagtagctgggattacaggcacacaccaccatacccggctaattttttgtatttttagtagagatggggtttcaccatgttggccaggctggtctcaaactcctgacctcaggtgatccactggcctcagcctcccaaagtgctggcattacaggcctgagccaccrcgcccggcccatacccatcattttttttttttaacttcttttctcaaagtacatcctacttctatggaaagattgacactcactgtcaaataaccatcagctagtcaagcattcagtttaaaatctgcaaacttggactgaaccgcagagaataaagtcctgcaagattctcaagacatgagacacttcagagatattaacaagtccacaatgaaattccaaatctagaaaaattgttttaaaaactttttggaaaacttttagaaggtaggaccttaaaagacatctggtacttaatta

SEQ ID NO: 204660 - DNA, 601 bp, Human
acacacacacactttacctaaatgaattgccacaaaactaaaattcaaagtttataaatgtagtgtgtgtgtgtgttagtttttttcctacattcttaagcagaatactaaaaaaacatgctacacctttttttttttttttttgagacggagtcttgctttgttgcccagactggagtgtaggggtgtgatctgggctcactgcaagctccgcctcccaggttcacgccatcctcctgcctcagcctcccaagcagctgggactacaggcgcccgccaccaggccaagctaattttttgyatttttggtagagacggggtttcaccgtagccaggatggtctcaatctcctgatctcgtgatccgcccgcctcggcctcccaaaatgctgggattataggcatgagccaccgcacccggcctcaacctttcttttttttttgagatggagtcttgctcccatcgcacaggctggtgtgcggtagcacaatcttggctcactgaaacctccacctcctgggttcaagcgattctccttcctcagcctcctgagtagctgggattacaggtgcacaccaccacgcccggctaatttttgtat

SEQ ID NO: 204661 - DNA, 601 bp, Human
tgatcttattcacaaatactgctttatacccacttagcatttcactattaaggggtatcaccattttgtgtagaataatgattaacattcccaagaacccaagtccatttcactttttaaagtgccagccacctaccacattattttcctggaatgccattatgattacacaatctaatatttaaaggcaaatgccaaactgtcaagagataaatgacattcttggcaaaatgtgtctgtcagagttttacaagtgatttttatacagttctgaaattttccagaaaggaagccaaaggcratgtctgggccttaaggactgacaataacaggtcaaggaccaaggattcagggaccactgagtcctaaatttactgataacaagttcataaaataaaagagtgccctccctgagctgtgtggaagggaatgaggtcctggcataaagaacgcgcttctgtgcagagggcagaagcaagtcgtgtggatttctgtgttcagacccacctgcttcctactctcctggagatgagtcacactaggaaagctgaagaaacttggcaattttcactacctggttttttgttttttggtaaaaaaa

SEQ ID NO: 204662 - DNA, 601 bp, Human
ttatgctgccttggaatggacaggcactaaatgagatagaaaaaagaatttaggtttagtccaaagaaaaacactgcattaaaaataagccattccatcaccactgaatgaatgacttgccacaaaatatataataattacttcactgctgttaccacgtgtatttatgggagagaccacgagtttctttctcctctctgctgcaaagtcaagggcaaggaaggcactaagaaggcaggttaaaataacaaaaataatgatcgatttctggatgtgctggtcaggctgggagactggtggsactcactagaagattcctcattactttctctgtttcacagcttaaaaatataaaatatccttcagacattgttctggtaaaaactcattaaataaacccataaatcacattttatactcatcttttttgatcttattcacaaatactgctttatacccacttagcatttcactattaaggggtatcaccattttgtgtagaataatgattaacattcccaagaacccaagtccatttcactttttaaagtgccagccacctaccacattattttcctggaatgccattatgattacacaa

SEQ ID NO: 204663 - DNA, 601 bp, Human
aactaaacctttaaaacttttaccaaaccagtaaaatgagaagctatgctaactttatgctgccttggaatggacaggcactaaatgagatagaaaaaagaatttaggtttagtccaaagaaaaacactgcattaaaaataagccattccatcaccactgaatgaatgacttgccacaaaatatataataattacttcactgctgttaccacgtgtatttatgggagagaccacgagtttctttctcctctctgctgcaaagtcaagggcaaggaaggcactaagaaggcaggttaaaatracaaaaataatgatcgatttctggatgtgctggtcaggctgggagactggtgggactcactagaagattcctcattactttctctgtttcacagcttaaaaatataaaatatccttcagacattgttctggtaaaaactcattaaataaacccataaatcacattttatactcatcttttttgatcttattcacaaatactgctttatacccacttagcatttcactattaaggggtatcaccattttgtgtagaataatgattaacattcccaagaacccaagtccatttcacttttta

SEQ ID NO: 204664 - DNA, 601 bp, Human
ggtctctctctttgcccatgctggtcttgaactcttgggctcaagtgatcctcccacctcggcttcccagagtgctgggattataggcgtgagccaccatgcctagccaggtgaaatgacttataagccatttatacaataggtggctggctgcactggctcatgcctataatcccagcactttggaaggcctaaggcaggaagattgtttgagcctaggagtttgaggctgcagtgagctatgattgtgccactccactccagcctgagagagagagaacttctcttaaaaaaaaaaaaaggcaaaaaacacaaaccacatgcagtaggctactaatagtgtgtactggtgtcctctttccaaccagagctccactaatatatgtgtctgttcaacttgggtatccagaagaagtcaactgaatttagttgtacaaagatattccagcccttaaaactgacaaggataatgaaagaacggagtagtgcagaagattaaacgagtttaacaaaagaagtcttaaattaattttataacataaaaatccacagatgcagcattctccatcaatcagaactaatttgctatgaatgacactga

SEQ ID NO: 204665 - DNA, 601 bp, Human
ggtagtttaggaggaggcaatatatactcttgtaagaagatatgcatgagctttggattcagagacggccgttcaaatcccaggaatgccatttactgagtttttgagcctagccaaaataatgtcagtttactccctgagtctttgttttctctttgcaaattgggaaaacagcatttcataggatttctgtgaggattagacaggttaaacatgtaaaatgtgtaagactgcattttgcctatatacataaaaaactggccagacgcagcggctcacgcctgtaatcccaacagtttgrgaggcctaggcgggtggatcacctgaggtcaggagttcgagaccagcgtggcctatatggtgaaaccccatctctactaaaaaatacaaaaattacccaggcatggtgatgcatgcctgtagtcccagctactcaggaggccgaggcaaaagaattgcttgaagttgggaggtggaggttgcagtgagccgagatcacatcactgcactccagcctgggtgatagggtgagactcagtctcaaaaataaaataaaaaatatacatgaaaaataggcgcttaattttagcttttctctccc

SEQ ID NO: 204666 - DNA, 601 bp, Human
aaataaataaaatacagtataacaactatttacataacatttgcgttgtgttagctattacaagtaatctagatgtgatttaaaggacatgggaggatgtgtgtaggttacatgcaaattctatgtcatcttataaagggacttgagcatctgtggattttggtatgaggtggtcctggaaccaatcccctacagatatcaagggatgactgtatataaagtgattgtgataagagaaagatttcctcactggttctgcagtccaactaaacttgcttttcagaaactacgcatgctaccatctgtctttgatattctattaagaaacagagtaaaagactgtaatagaagaacacataccaacacatgtacttacttccttgtggtccataaaacttcactacaaattcattaagtcctcccaggatcgtaacctcatgtttactctcgatgctaaggtggacggtaaaggaaattacacaggctttacagtatctggcagaattaccaataacaccccaggcatatgccacttaaagtgttaccaaaatttggcatgacattgataaaatatacataataattctggtagtttaggagg

SEQ ID NO: 204667 - DNA, 601 bp, Human
aaaggagatgaaggtgaggagaaagtacctctttgtacaaccccactgaggtttctattctttcttctgctgtttagggggctaaagagactggaggtgggaagactgcaaagggtcatttaattgtaaggtacccagagttggagtgaacaaaaaagcaaagtaggatctagggagaatttctgaaaatgataggattaaaacacatactatgtaacattcattcttgcaatctggcattcaaaattagacttaagatatgtttattattttcctgctaacagcttaaagaacagtgggrccttaaagctggtttaatctgacaccaaaagacaaaaatctaaagtaatggtcattataattatgcaaagagtatatttaaacgtcttctaacacactatagaagttccccccaaaagtcactgattaattaaccaaagccaaaaaaggaaaaattcaattagacagccatttctggcattaattacctcccctgaaatgtaagatttttcccccttagatttcaaaactctctaaggagaaaaaccaagtagtaacatacctatagatggagatttgaaagggtatttatcaggtaggt

SEQ ID NO: 204668 - DNA, 601 bp, Human
actcgggaggctgaggcagaagaatggcgtgaacccaggaggcggaccttgcagtgagtcgagatcgtgccactgcactccagcctgggcgacagagtgagactccgtctcaaaaaaaaaaaaaaaaaaaaaaagcccacagcagtagcaaaatgtttgaactctggcaattctgaacatgaggcttagtctgattctcagagaatgctcaatatattacaattttattgttcttacttaaaattgttcaatattttataatattttagacatgtataaagtgaagcaaaaaaaaaaaaaagctggcttaaattaactaaattactaccattctacagtctccaaatatttaaaggtgtccaccttcaatcagatagatctgtcactgagtgcctcaatgggggtgacaggtaaataacatcacccattaaggtaaaaggagatgaaggtgaggagaaagtacctctttgtacaaccccactgaggtttctattctttcttctgctgtttagggggctaaagagactggaggtgggaagactgcaaagggtcatttaattgtaaggtacccagagttggagtgaacaaaaaagcaaagtag

SEQ ID NO: 204669 - DNA, 601 bp, Human
tctccttcctccgtctctcgagtagctgggattacaggcacgcgccaccatgcccggctactttttatatatatatatttttagtagacatggggtttcaccatattggtgaggctggtctcgaactcctggcctcaagtgaacctcctgcctcggcctcccaacgtgctggtattacgggcatgagtcatcgtgcccagtcacagaattcattttatttgtgaaaatacagtggtacaagtaggcctttgttaaatgactaacctgaaacctcttgtgaatgacaaactcctctctactscaaatactggcccatccctgcttaaatactgctcaatgaagttactcatgctagttcttgagggagtaactctagaatgattccatctaggaagacataagataaaatggtaagtattctaagttctataggtagtttagtcatgccatattataaacctccactccaaaaatagtgtgaggtcatttctggccagagtgaaataaaaaatgtataatgcctgaacagtctattattctgacaatgaaaaagattaatgcagttccctttatcacttgcatgagtaaaaaaatatatata

SEQ ID NO: 204670 - DNA, 601 bp, Human
ccccatctctcctacaatacaaaaattagcttggcgtgttggcacatgcctgtaatcccagctattcgggagactgaggcaggagaatcacttgaacccggggggcagaggttgcagtaagctgagattgtgccattgcactccagcctgcacaacagaacaagactctgtatcaaaaaaaaaaaaaaaagatatagatcactacagagtagccattatgtaactgtttgggacaggactaaagtcataaccacggttattagagaagtacataggtgatctgaatggaattttgcctccycagccccaaaattcattttatttgagacggagtctcactcttgtcgcccaggctggagtgtagcagcgccatctcagctcactgcaacctctgcctcctgggttcaagtaattctccttcctccgtctctcgagtagctgggattacaggcacgcgccaccatgcccggctactttttatatatatatatttttagtagacatggggtttcaccatattggtgaggctggtctcgaactcctggcctcaagtgaacctcctgcctcggcctcccaacgtgctggtattacgggcatgagt

SEQ ID NO: 204671 - DNA, 601 bp, Human
tgattttggaggatcagggctggtttttgttttgttttgtttttaatctttttaagtctcagcttaaatttactttgtcagacccttcctgaatatctgatccaaggtacctattctatccattaattctctgcataaagctatcagaagttttaaattttgctttatcttcgcactccaaaagaacataaagtattaagagagcaatttgttcacttctgtatctacagcacccagaataacgcccagctcgcagtaggtatccaataactttgtgaaactgattggaaggatgatgtakgccacagccaaagcctcagctgccagacataatttttgaaaaatgttattttcagaacaccagtaaaagagcttttaacaatggcttatattctcatagcattatctctatttatttttttacaaaaccttccttacttactagaaccttgtttctctctactggaattcaaaagatacttatcattggccaggcacgttggctcacgcctgtaatcccagcactttgggaggccaaggcaggcagatcacctgaggtcaggagttcgacaccagcctgggcaacatggtgaaaccccat

SEQ ID NO: 204672 - DNA, 601 bp, Human
atctcagcctcatttttttccatccttaaaatcaggcaaattggatgtcataatctctaaacttccactaacaacacagttttcaccaacaccaggaatataagcaaatctcaaactgtgaacaggtttctaaaaagaactaagacattgcttttgttgttttcaaaagaatttcagtttaaagaaaaaggaagccaaaaatacttgttttcattatgacaccaaatcctaaagggaaagaaatagatttaatgccaaaaagatgtcagaataaccagctcaaaagctagaggtcacccartacagagtaggaactaacctaggcagcaagtgtgatggaagttttaaatagcaaatgaaaagattatataataatgagctgtcaaaggcagaattaaaactggcataagtcaacttcaagaaagaaatggactgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcagga

SEQ ID NO: 204673 - DNA, 601 bp, Human
ggcaatctacttcatctctttgcctttctgttcccttattcctaaaactaggttaaataatggtatctacacatcattaatcgtgaagattaaatgagttaatatatgtaaagcatttgaacagtaactggcatacagtaagcatgcagtaatgttagaattagcttaataagttaaatgaacaagtaatttcatcttactgtcttcatcctaaaactgattaatatttaccctatgtgtccatctcttaatgctcttacaagtgtgaagaacatgagaggatattatgatttacatatgyttcccataactctgtcacactagaaatggaaaatacaattataatttttatttttaatatttattatttgtgtgacacagccccaggaggtcctgagaacatgtgccccatatttattattaagaagaccatcctacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtaggga

SEQ ID NO: 204674 - DNA, 601 bp, Human
gacccaactacaattctctaccactcttagagttgtagttaaaagatcaggctccaaaagataaatgtttgaggtgacagatatcccaattaccctgttttgatcattacgtattgcatatatgtaccaaaatagcacatgtaccccaaaaatgtgtgtaactgatgtaacaatacattttttaaaaaggaccaggctccagtcagaatgcctaaatgccactgtgtgagcctctggggcaatctacttcatctctttgcctttctgttcccttattcctaaaactaggttaaataatggwatctacacatcattaatcgtgaagattaaatgagttaatatatgtaaagcatttgaacagtaactggcatacagtaagcatgcagtaatgttagaattagcttaataagttaaatgaacaagtaatttcatcttactgtcttcatcctaaaactgattaatatttaccctatgtgtccatctcttaatgctcttacaagtgtgaagaacatgagaggatattatgatttacatatgcttcccataactctgtcacactagaaatggaaaatacaattataatttttatttttaatattta

SEQ ID NO: 204675 - DNA, 601 bp, Human
gctaaaatgcttacccttctctgtcctgcgtcttttagcagaagggaattaggtaatttataattctggagaaggaatccaaatcacacttaatgtaaaactattattatatatcttaaaaaataaaaagtacagattacaacagaaaaatatgccttgcttttgcttgttccactccaatactcaactgctctagaataacaaatctcatgacccataggctaataggcagtgaaaataaataacattgtgctaagtcatgctgaaaaactggtttttatttcagcctctgtgtccagtyccaggaaggggtctatacagagttgcacacacttctgagtaacttctgacattggggtcaatatgtaaataaatgaggccaagcttcacctatttttccatctttgttccctttatttgagaggatattaatgatcaaatttgtgggtagatgaaatactttgggccaatcaccagaaatttcacctgtcagaattatcttgacaaaaggagaggttagacaaacgacttgtgaatcaaggtaaatccaccctacggtaaacgggtgaagatcaccaaaggccaaaacagcagctacatc

SEQ ID NO: 204676 - DNA, 601 bp, Human
ttttagtagagatggggtttcaccatgttagccaggatcgtcttgatctcctgacctcgtgatccacccacctcagcctaccaaagtgctgggattacaggagtgagccaccgtgcccggccactaccagacattttctaacaacatatttcagtgatttgaccagattaaaatcagaactccttaagttttttggacagttattctctggcgtagttctagcactcgttaaaggggatggggaggatcgtacaacaggaataaatgtccagctaaaatgcttacccttctctgtcctgcrtcttttagcagaagggaattaggtaatttataattctggagaaggaatccaaatcacacttaatgtaaaactattattatatatcttaaaaaataaaaagtacagattacaacagaaaaatatgccttgcttttgcttgttccactccaatactcaactgctctagaataacaaatctcatgacccataggctaataggcagtgaaaataaataacattgtgctaagtcatgctgaaaaactggtttttatttcagcctctgtgtccagtcccaggaaggggtctatacagagttgcaca

SEQ ID NO: 204677 - DNA, 601 bp, Human
attttgtcatccttatcacttcatttccttttaggactcattctgttccacactttcaatatctgaagttccttattaaggtgagtatcaccaccactatctccgacccccatcctccatcacccccatccccacagtctctctctctctcattcattcagaacatatttggtcagcacctacaccgcaggcattgtgcttggatagggtataaaaataagacagttcactattcttgaggaggtcactgtggcagtgggacaagagacaccaataaatacctgcaatctgaataaagtaytgatacagtaggcggagtaaaacgggaagagtcaggaaagatgcagagaaatggcactggaggaggagcctcaagtgaggcgctacagagattgtctccaaaaacctgagaaacttcccctgaagtagaaaacaggggataagaataccaagtccaagtagtccagtcttagaccactctagtcactcacacttttaacttttgtttttaaatgctctgtgttgaaacagcataatgttctatctactacaatcaagagggcctatgtgatgtttaagttactctgatgaaaaaaaatct

SEQ ID NO: 204678 - DNA, 601 bp, Human
cattttgccttactatctatcaagaattgagaaaatattataagatctgaaaatagtctatctgtaggctgaaaacagatctctgaactgtgtctacaaaaagagaagtgagatgtggaatattactactgtttgctggataacaagaaaaatgaaggacccagtcacgacaatggaaaaaaataagtggtacaacagcagaatgtgaactaagtgattgagaacctcatatcctttggattctatcatttacatgaccattcatacagtcctacctcctgataaggtccaaaaagataaycgaggctttttataacacagagaaacactaatcatgagcagttgctgctaaaattgaaacattttaaaatagttacttacgcttcatcaatgttgggatggaaaattttattcatgaatcctgtaaaaagagatgttaattagcagcaaaaagtatccagagaacaataaaagtatttcagtactggaaacaatttcagtattgggaaaaggtgataatacttataaatcactactttcaaccttagatctttcattactgataaacattatattctcctgatagctccaattatttgga

SEQ ID NO: 204679 - DNA, 601 bp, Human
ggccactttacaaagtagtctatcagtcctcaaatagttaaacatattatccagcaatttcactcctaggtatatacccaagagaaatgcaaacatgtctacacaaatacttgtgcacaaatatttataacactcataatagccaaaagacagcaataacccaaatgtctattatctgacaaataatgtggtttatctacacaatgaaatattattcagccataagaaattccgatacatgcaacacggatcaaccttgaaaacattatgcaaagtgaaaaaaaaaacagtcacaaaagaycacatattatataattacgtttctaagaagtgtccagaaaagacaaatccacagaaacaaaaagcagattcgtggttgcctagggcgaatagttaaagggtacacatttatttttgaggtgatgaaaatgttctaaaattgactgtggtgatggctgcatataactgaatgtattaaaaactactgaattacacactttaaatgggtgatttgcatgtctgtgaattataattcagtgaaactgttatttttttaaaaaacctgttctgagacatgaagtacttgacagtcagcaaacat

SEQ ID NO: 204680 - DNA, 601 bp, Human
aaatacatttaaatctcagtagtagcattttggtttttaagtattcaaagctagaaacaggtgttcctgtgctgtgtgggaaagggcaatatgaaagatgcagggcgctggcctggcgtggtggcacacgcctgtaatcccagtactttgggaggccgaggcaggtggatcatgaggtcaggagttcaagaccagcatggccaagatggtgaaatgctatctctactaaaaccacaaaattagccaggtgcggtggcaggcgcctgtaatcccagctacttgggaggctgaggcaggagawctgcttgaacccaggtggcagaggttacagtgagccgagattgcgccactgcactccagcctgggcgacagagtaagactctgtctcaaaaaagaaagagagagagagagaaagagagagagagggaagggggatggggggagggacagagagagagaaaggagagagagagaaagaaagaaagaagagaaaagagaagagaaaagatagatggacagatggatgcagggtgctgaaactgggaaaaccagccacattctgctcagggccaggctaccaggccaccaaactgaggtgtgt

SEQ ID NO: 204681 - DNA, 601 bp, Human
cacctagtttactgaaggctaactagctgcaattaagataatataacccgccaccaaatactaaaaggtatattaaagaattcatacaattacttgactgagagggtctcatgtgtggagaaaatatataaaaagtctaagctcagcagattcacatatcttctcatattagcccatggggatctttaaaagataaagtcttaatgaagagggccatgcaggcaacaaaacaaaacaaaataaaaaaacaaaaacaggtgaaaacacctccgaaaagaagtgggatgcttaaaaaacacamcaaactcttccctcctcccacctctcaaaaaaggtggctgggtgcagtggcccatgactgtaatcctagcactttgggaggcccaggtgggcagatcacttgagcccaggggttcgagaccagcctggacaacatagtgacacccccatctctagtataaataaaaaattagcctgatgtggtggtgcatgcctgtagtctctgctatttgagaggctgagacaggaggatcacttgagcccagaaggttgaggctgcagtgagccacgctgcactccagcctgggtgacagggcaagac

SEQ ID NO: 204682 - DNA, 601 bp, Human
cctgcagtgctgtggctcaggcccaactggccacagggctcacaatgctgcacctagtttactgaaggctaactagctgcaattaagataatataacccgccaccaaatactaaaaggtatattaaagaattcatacaattacttgactgagagggtctcatgtgtggagaaaatatataaaaagtctaagctcagcagattcacatatcttctcatattagcccatggggatctttaaaagataaagtcttaatgaagagggccatgcaggcaacaaaacaaaacaaaataaaaaaacaraaacaggtgaaaacacctccgaaaagaagtgggatgcttaaaaaacacaccaaactcttccctcctcccacctctcaaaaaaggtggctgggtgcagtggcccatgactgtaatcctagcactttgggaggcccaggtgggcagatcacttgagcccaggggttcgagaccagcctggacaacatagtgacacccccatctctagtataaataaaaaattagcctgatgtggtggtgcatgcctgtagtctctgctatttgagaggctgagacaggaggatcacttgagcccagaaggtt

SEQ ID NO: 204683 - DNA, 601 bp, Human
catgagccaccgcgcctggccatcctacaattttaaaggaataagtctactgggtgtggtggcttgtacctgtaatcccagttactcaggaggctaaggagggaggatcactagagcccaggagtttgaagttacagtgagctatgatcacaactactacactccagcctggatgacacagtgagacccagtctctctttttttttttccagagacaagttctatgttgcccaagctagtcccaaactccaaggctcaagtgatcctcttcgccttggcctcccagtgctgggattacagkcgtgagctaccatgcccagctgaggcccagtctctttaaataaaaaagaaagaaagaaaaataagaagtctatgttggtaactaccaaatccatataactggtccttcatatgtctagtcttgtagtcttatcaaactttacatgtctaagattattttcctgaaaacccattcccttcacctaatgaagggagtaggttgactctaacgccctggctctcaggctccaagcctctggaaggaatctggctaggtgttcttcctttcttccatgtactcactcagtttcccagaaatgtc

SEQ ID NO: 204684 - DNA, 601 bp, Human
acagcgttttgccatgttggccaggctggtctcgaactcctgatctcagggtgatccatccacctcagactcccaaagtgctgggattacaggcatgagccaccgcgcctggccatcctacaattttaaaggaataagtctactgggtgtggtggcttgtacctgtaatcccagttactcaggaggctaaggagggaggatcactagagcccaggagtttgaagttacagtgagctatgatcacaactactacactccagcctggatgacacagtgagacccagtctctctttttttttttccagagacaagttctatgttgcccaagctagtcccaaactccaaggctcaagtgatcctcttcgccttggcctcccagtgctgggattacaggcgtgagctaccatgcccagctgaggcccagtctctttaaataaaaaagaaagaaagaaaaataagaagtctatgttggtaactaccaaatccatataactggtccttcatatgtctagtcttgtagtcttatcaaactttacatgtctaagattattttcctgaaaacccattcccttcacctaatgaagggagtaggttgactcta

SEQ ID NO: 204685 - DNA, 601 bp, Human
gtgcaaagaagcatgctaagcaaaggacgttcagatgtttctgtggctattcacagagacggtgtgcttgttttcatgcagctccaccgcaggaggtaacccgcagacacctgcacacagcgaacggaaggctcctcctgccatattattattacaggtgctgctcaaaaggattagcagctggatgctattacataacaacgaaaacctttaaaaacaaagcataggttttatgttctgaagtaatgttcagaagtgcttcagggctagagaaatatcacagacaacgtgttataaaackaggagtttagcgtgtcccagaaagagattttataccctttcctactacttttaagtttcctcaagctaccaataaaaggctttgcctatgaatttgttccaaacaaataaaagaacccttaattattggttcttccttcctgtatctaccgtcttcctgcattaacacatttttgatccattttacagaagtgctgagtcacacctgtaaaacagaagagcagaaaaggaaacacatgaggcccagttttgggtgaagatgacaacttcgggaggccaggatgtgatggctctgccatct

SEQ ID NO: 204686 - DNA, 601 bp, Human
tgcctggctaatttttgtatttttagtagagacggggtttcaccatgttggtcaggatggtctcaaactcctaacctcaagtgacctgccagccttggccttccaaagtgctgggattacaggtgtgaaccactgcgctcagccttgaacacaattttataggacttgacatttaattcaattcttgcaacttctaatggaggtaaatataaccaatttttcaattattctgggtaatgaggataggaatctatatggaccacataagactacaaatattcataagacagataagcaccartctactgcatttatttatttaaaaaagttttttttttgagagaggatctcactctgttgcccaagttggagtgcataggtgtgatcatacctcactgcaacttcaaactcttgggctcaagccaacctcccagcctcagtcttccaagtaaattggactataggcatgtgccaccatacccagctaatttttttttttttaaatagagacagggtctccttatgctgcccaggctggtcttgaactcctggactcaagagatccttccatcttggcctccccaagtgctgggattataga

SEQ ID NO: 204687 - DNA, 601 bp, Human
tgggaaaataggattctaaatcgcaaaggatgagcaaactggtgctactgccacccgaggttggtgagcactacttcagcccacagctgtctctttttaggcctaagaaaaagtattaggaactaagtaatttaagaaggacttttaatgactgaagcccaacagatttaagttcttttgtctccaggttaaactacccatcctcttacctttaattttctgcttgtattcttctggtcggtggaggtacatggctgcagcgtcaccattgagaggatctatggggttaggataggccaayaactgaggcaggaaggactcaaatatattggtaagatctgaaaaaccaaacaaacatgtcacacatgggaaatgcaagttcacctaaaattcacttgcattcagtagtcaagctgcttaccttcttagatattcacacggggatgattctccatacgagtgtgctctattacatgtgacttgtattacacattcatttcaataccaatttaaacattttaattttaatttgaagaacgagataaagatatacctgacattcactttgaaggacaattttcccaattctatttcactctat

SEQ ID NO: 204688 - DNA, 601 bp, Human
cacatttaggaaatggaatgagaagtttccagaaagatgagggtaaaatgtaacacttgcagaaaggtccagcaaaatgggacttgagaagagtccaaaggattgggaagaaatgagggcacagattaagcagaggaggggaaaaaaactagaggagtttaaggtgaggacgcaagaagtttgaaaatgaaaaggaataaacagcatgactcctaagagagcccacaggagcagatcactgctcctgaaacagggagacctctgatggggtggaggaggaagactgcattgggagggggcrgggggttgggggaacaagatcacagattggtggtgggagtgagtttgagaaatgaggaagggtgtctcttatttatttcctatagttaggaacaaagaaaagatgcaggagggaagggagaagatatcaaggcacagtaggaagtgggggtgagctcaggtctgatggccatgattttctgagattactaaggaagacaaaatgatagccaacatgaacatttccgaaggctaggggtccgtacgctggagtgagccattctaagataaatgtaggctcggttctttttgtaaatgggac

SEQ ID NO: 204689 - DNA, 601 bp, Human
ttgagagagagaaaggaagagcaaggtcaccaatgaggaggaggaaacagaggaagataaaaggagctgctgagtgtcaccagagggaagcagttacggacgaaaaacggccgaggcagtcccagccacactgacccccaagtcctgccagctatggcataggagaggccactccagggaaaggctttgttttgttgaaagtaagtggctgggatgtttaaacacaaccttaagagagaactatggccaggtgcagcggctcatgcctgtaaacccagcactttgggaggccaaggcgggyatatcacctgaggttaggacttcgagaccagcctggccaacatggtgaaaccccatctctacaaaaatacaaaaaactagctggatgtggtggcacatgcctgtaatcccagctactcgggaggctgaggaaggagaatcacttgaacccgggaggcagaggctgcagtgggccgagatcgcaccactgcactccagcctaggcgacagggcaagactccgtctcaaaaaaaaaaaaaaaaaaaaaaaaaaaaaaaaggagtaagggcaaagatgtagattccactcagtatcagagagc

SEQ ID NO: 204690 - DNA, 601 bp, Human
tcaaattcattataacaaaattttatgctaatgattttgatgagattaaagtagcccatgattaggtaggaatttaccttaattgagaaatatttattcaaactttaacaattttatttttaacctctaatgggttgactattttgcgtcttcctttgtagaagataaatattgacctttttttgacactagaatttgatactatcagccctctttaatgtattcaaggaaacaaatgtatattaagtacttactaggacaaggcctttgagagagagaaaggaagagcaaggtcaccaaygaggaggaggaaacagaggaagataaaaggagctgctgagtgtcaccagagggaagcagttacggacgaaaaacggccgaggcagtcccagccacactgacccccaagtcctgccagctatggcataggagaggccactccagggaaaggctttgttttgttgaaagtaagtggctgggatgtttaaacacaaccttaagagagaactatggccaggtgcagcggctcatgcctgtaaacccagcactttgggaggccaaggcgggtatatcacctgaggttaggacttcgagaccagcc

SEQ ID NO: 204691 - DNA, 601 bp, Human
gatgacagtaatcatgatcactacagctaaggagaatcccatagggagacttctttgggacagggtttctgcattttgccccctgaggaaaggggtattgggaagagcaacacagcaggctcagcttgcaggggaatgtgtgtgctgcagcaccccaagaactcttcagggaccagggaaatgggagccccacgctttctttttactttcatctcccagatagtataggaccagtcatgattccatagtaatttataaggaaatccttcatcatttttagatctgcagttacataattacrgtcagtccaggtctattattttaggaatcgattttagtctaaacagatcctgcctgtcaggtttttgaagcagctggcaaaaaccatcgctcaatctgctcaggactaagctgctatacggagacaccactcggctctgagtggtttttccatgtataatttacctgaaggtagatttccgctgctacagccttggtggaaccctaggctgaataagactgctgaaacggcttttaagaactgctgaataaacaaacttgttcctaaaaactctaagtgcatactgttttcaagtgaaca

SEQ ID NO: 204692 - DNA, 601 bp, Human
gagaattggttgaacccaggaggcagaggttgcagtgagtcgagatcacaccattgcactccagcctgggccacaagagcaaaactctgtctcaaaaaaaaaaaaaaaaaaaaataggggaggtggtggtaccggtcatctagtgggtagaactcagggaggtggctcaatatcctacaatgcccaggacagacgccacaacaaagatcggctggcccaaaatgtcaacagtgccagggttgaaaaaactcgctttaggagaagacaagaaaagaagaaaatgcttcataatataaaatawcctaatattctcttatgctacttcttctataagcacaaatagacaaagcacacactgtatcttaaaattccacatttagagttaatgagaattgatgttatatgacaagatctgcagccgggcaggagggagaggacaggtcagctctgatttcccaacataaacccctccttactaaatggtaacatgactttatcttcgggcactgctccagagtgaaataccttaccaataaacatcaactccagccttattatttaattttatttatttatttagagacagagtctcactctgtcc

SEQ ID NO: 204693 - DNA, 601 bp, Human
cacacaaaggcttcatgaaattctggagcctttcaacaatagaagacaggaaagaggatcgggcaagcggggaagagagacagagacattctgcactcatttctgttttaaaagtacgtttcagacaaacagactagcctcataacaaactacctggcagggcagtgtgctgaagagctctgagcgagtgagcttattggagatataaccccaggagcacaggaagtcacctgcaaggaatcctggctagagtctcagatagaacccagagagaggctcccagaggctttgccgggggctrggaagccaatgaccaggacatgcaataagcaagagatggtcacagaaagtcaaagcaaataataaagacggcaaatggaaaaacacgtccataagaggtcgaatcgggaggtgcccagaggtcagacacaatccagtgaaaggctaagtggccttgcttgttcccagaaccacatgttggcagacagtggaggcagaaacgcatgcagttctcgcaatgcctgaagatccctccaacctcttaaagtcaacaggaccaaaaccaaactaactccttgtgtttctcccagaccccagcctc

SEQ ID NO: 204694 - DNA, 601 bp, Human
atttcaaataactgtcccttaaagttctatgatcaagcaaagactcaatttcacaaatataaactcaaaaactagaactcaggattgaaaaaaaaatctagttcaaaatatgtaggcaataaagctcaaaatcttttaagtatcagacagtaactaagcacctgctgctatgtcgactgccattaataataagccagtcttccctcttaggtttctacccctccgcctaaacaacaaaaacagctttagtggccattatttcaggaggtcggagcacatgctgcacctgtgagcttcaacmtgtgttcttggcttgtacctgccagcagagcaggatccctccaccatctcaccacacaccttctcaacatgaacacggacatgcacataaatctaggacattctgaaagaaggggaaatactcagccatgagaaatcctgtccatacggatgggggatctcacagtaaacaaaggtctagcccataatgactgaaagttcatttgagagttagaaggagaagataaatctttcctatttaggtaaattaggtgagataaaatatttgttagttaacacacaaaggcttcatgaaattctg

SEQ ID NO: 204695 - DNA, 601 bp, Human
gcagctacccatctgcaggattaagtgaattaattagcagactccgtggcaagtaagagatgttcgagaaagatcagttcacttttccttcttcctcatccccattttatattgccacagagactatgtatagtccctggcacagttcctggcctttgtaaattgctgaaggccaattccagcaccaaacccaagggacccccttctcaccacctctccttcatcttcaaaagttatctctggatttaatcaactggctggattctcctgaatcacagaaccaaatggcacacattcacaraaacatcctatgataaaaataatagacatttctacatgagatggttcttaaaggttagttaggccaagggcagacaggtcttatgcacagcctgtgagctggcaatcatcctgcagaatgctgttagaatttcctcttcttgaaaaagagaaacaaaattcttcttaattacttttagaactgaattagtaaatgtttggtctaaaacgtactggtaaccaaattttggtcactatgccctgaccagtatttcaacttctaccattactacacttgtctcattggataaaataaagcagg

SEQ ID NO: 204696 - DNA, 601 bp, Human
tgtgaacatttcagcaggagctcgccaggtgagcaaggggaggcatcccaagcccgggacacagacacatagaggccctgaggcagaacacaacggtgtcatggaggatacaggggtaactttatatggctcaggtgagggcttgggtctccagtgagaaattaacccagaaagcccagactggaagagagcacctggagtttctgccgaagatctctgcatttcacagcctgaacaaatgccttcaatttctctcctttccactctagcagccagggaaaaagtctagggacaaataatratgaatatcagtgggtaacatctaataaatgctcactgtgtatagggaagtattctgagcacttgtgtggacccttctaaagctcataagcccaagaggcaggcattaccattactatccccactttacagacagaggtgacggagccagttaggggaggccctggggaatgaacgcaggccgcctgactccacgccaagtctcctgaccactgtgtgtactgagaggagagccacttcgctgagatctgctaacaggggtctaagtccagatgattcctgagtccctcaggcacagtct

SEQ ID NO: 204697 - DNA, 601 bp, Human
acgagggaggtgggacgggaaccctgctttctgactttgagagttcagttccccccacctttttttctgaacatgcaaataaagtgaccatttttacatttctgaacaaagtatctttaaatataaaaagatgtcttaaaaataaagtttcttcataaatttcccttttgagaatttgggagaaaacttcacagacttctaaacctcaagaaattttgtcatctgccctgcctttctgggtcttacgaagtacaaaagattcagcacacacacacacacacacacacacacacacacacccttctgtcagggttccacttgactacaaggttgtcactattaaacagtcaaaagcgtatgcaaaacgacactacaatatgacaatctgcagcaggtcaaagtcatgccttcggagggtttgcttaaccaagcaaaaatgaaccgaacccaggggaatgaacgcaggccgcctgactccacaccaggtctcctaaccactgtatgtactaagaggagagccactttaacaggcgtctaagtcgagatgattcccgtgtccctcaggcacagtctgtttggcagctacccatctgcaggatta

SEQ ID NO: 204698 - DNA, 601 bp, Human
cacgagggaggtgggacgggaaccctgctttctgactttgagagttcagttccccccacctttttttctgaacatgcaaataaagtgaccatttttacatttctgaacaaagtatctttaaatataaaaagatgtcttaaaaataaagtttcttcataaatttcccttttgagaatttgggagaaaacttcacagacttctaaacctcaagaaattttgtcatctgccctgcctttctgggtcttacgaagtacaaaagattcagcacacacacacacacacacacacacacacacacacacttctgtcagggttccacttgactacaaggttgtcactattaaacagtcaaaagcgtatgcaaaacgacactacaatatgacaatctgcagcaggtcaaagtcatgccttcggagggtttgcttaaccaagcaaaaatgaaccgaacccaggggaatgaacgcaggccgcctgactccacaccaggtctcctaaccactgtatgtactaagaggagagccactttaacaggcgtctaagtcgagatgattcccgtgtccctcaggcacagtctgtttggcagctacccatctgcaggatt

SEQ ID NO: 204699 - DNA, 601 bp, Human
tcacgagggaggtgggacgggaaccctgctttctgactttgagagttcagttccccccacctttttttctgaacatgcaaataaagtgaccatttttacatttctgaacaaagtatctttaaatataaaaagatgtcttaaaaataaagtttcttcataaatttcccttttgagaatttgggagaaaacttcacagacttctaaacctcaagaaattttgtcatctgccctgcctttctgggtcttacgaagtacaaaagattcagcacacacacacacacacacacacacacacacacaaccttctgtcagggttccacttgactacaaggttgtcactattaaacagtcaaaagcgtatgcaaaacgacactacaatatgacaatctgcagcaggtcaaagtcatgccttcggagggtttgcttaaccaagcaaaaatgaaccgaacccaggggaatgaacgcaggccgcctgactccacaccaggtctcctaaccactgtatgtactaagaggagagccactttaacaggcgtctaagtcgagatgattcccgtgtccctcaggcacagtctgtttggcagctacccatctgcaggat

SEQ ID NO: 204700 - DNA, 601 bp, Human
gggtggccagggaggacccggcggtgcgcagaccagataccccaacaccagcgcggcaccgggatctgacccagcccagaggcgtctccaaccccatttctccccctcgacccaacacaagctccagccttaatacttaactccctcagcttcctgcacagcccactatcctccacctcctctgtgagcctggcatcaaaaccaggcaactgacctggagatcttgactccaaacggtagggtgaaggtgaaaaatcccagaggcttagaggtgcaaaggaccttcagagactcaacatcytaaattttcagacagagaaaatgggacgcagaggaatgaagcccagtgccacactgatagctcacgagggaggtgggacgggaaccctgctttctgactttgagagttcagttccccccacctttttttctgaacatgcaaataaagtgaccatttttacatttctgaacaaagtatctttaaatataaaaagatgtcttaaaaataaagtttcttcataaatttcccttttgagaatttgggagaaaacttcacagacttctaaacctcaagaaattttgtcatctgccctgcctttct

SEQ ID NO: 204701 - DNA, 601 bp, Human
ccactttcccatacaagaaaaaatgaatagcagagtaaaatagcagaaggtgatttataatagcacaatagtgcgaatatgtcacagtcagctgtaaaataagtacaatcaataaagacatgatcttgggatgggtttgtatgttgaggccaaaaatgagaaaatatacacaacgagcgatgtttccacttctttttagaatgaggccaaagagaaatgctaaataaatgtattattagagattccacagtataaaggatttttaaaactgcaagaaaattctattttctacttaagagtrtacactaaaagtggatctataaaaactggcaagataaaataaatttgatgctacttgatacagatgatttcaataaataataaattcttagtgtgaaggcaataatcgtaaggagaaagaaaatgctgtgggtaaaatcagtcactctaggtttaaatttgcagtctataactgttacttattcagaagctggtcactgggtgaaaacaattaccaggcccattcttcattcctgttgtttctagggccattttatagttccttagatactctacccagaaagtaaaaatgggtatacac

SEQ ID NO: 204702 - DNA, 601 bp, Human
attttctaacaaaaaaaaaaagagagagagagaaacatcttggattatattggtttcactgataactcatgtaaaattttaaagatttaaaaaactaaaaaaaaaaaaaacatagcttagaataaactaactgatactaaaatattttcactccatcctaaaggtctatcttaataattggtaggaaaatcaaatcctaaaaattgatattttggaaaaaataactcatcttgataagacagtaaaagatgagggtggctttttgtaatatctaatattttccttgaaatatatgtattatggagagagagagagagacacttggccaagtaaactgaatctaaatcatgttttgaaacttgtcaatcttctcactcttgttagtaaatacatgcagcaattttaataagcacacatcactttttttttttttgagacggagtctcgctgtgtcacccaggctggagtgcagtgacgcaatttcagctcactgcaacctccgcctcccaggttcaagcaattctcctgtctcagcctctggagtagctgggactacaggctcctgccaccacacccggctaatttttgtatttttagtaga

SEQ ID NO: 204703 - DNA, 601 bp, Human
atcatgcaagtacaataggcctaggcagcagaatcacttgggcccaagttcaaagccaacctgggcaacattgtgagaccccataactataaaatacaattttaaaaaattagctgggcacggtggcatgcccctgcagtcccagctacatgagaggctgaggtgggaggatggcacaagctcaaggggctgaggcttcagtgagcagtgactgcaccactgcactccagcctgggtaacagggggagaccctcaaaaagataaaagtaaaaaaaaatttaaaaacaacctttcccggccrggcaccgtagctcacgcctgtaatcctaggcagatcacttgagttcaggagttcgagaccaaactggcctacatggcgaaaccccgtctctacaaaaaatacaaaaattagccagccgtggtggcgggcacctgtagtcccagctattcaggaggctgagtcttgagaatcgcttgaatgcaggaggccgaggttgcagtgagctgagattgcgccactgcactccagcctaggcaacaaagtgagactctgtctcaaaaaaaaaaaaagagagagagaaagaacctttcactaataaca

SEQ ID NO: 204704 - DNA, 601 bp, Human
gaagacacagatgacaacaggagactaacttgtccataaatgtggattaaaacaacacaggcctttatattccatttccatcatgcaagtacaataggcctaggcagcagaatcacttgggcccaagttcaaagccaacctgggcaacattgtgagaccccataactataaaatacaattttaaaaaattagctgggcacggtggcatgcccctgcagtcccagctacatgagaggctgaggtgggaggatggcacaagctcaaggggctgaggcttcagtgagcagtgactgcaccactrcactccagcctgggtaacagggggagaccctcaaaaagataaaagtaaaaaaaaatttaaaaacaacctttcccggccgggcaccgtagctcacgcctgtaatcctaggcagatcacttgagttcaggagttcgagaccaaactggcctacatggcgaaaccccgtctctacaaaaaatacaaaaattagccagccgtggtggcgggcacctgtagtcccagctattcaggaggctgagtcttgagaatcgcttgaatgcaggaggccgaggttgcagtgagctgagattgcgccactgc

SEQ ID NO: 204705 - DNA, 601 bp, Human
atattgataattatgatgaaaaaagtagtttactgacagccttaaaaaaattacacacacgccatcctaacaaatcatactgacaggtttccgtaaataaaaaatacttgctgagccagtaggttacatattcatttatctagaaagacctgtgctggcatcagtcaggtaaataaaaaccctctgccttcagtttgacaagtattaaatacaacgagaacatccagagatacttgagatggtcacacttaccggaggcttgtttaactttggtctgtcatcctgcaatgaaaagataagscacattatggaatttaaaaatctatgaaagtaccacttccaaaatgctgactttgagactttttaaaattataattcagtaattaccatttcagattcaacatttagctattaaacacaaagtttgatccatctgatttaacagcaaaaattagtagcagattaagtgccaagagatattttctatctagagttccaaagtttcgaacagcacccatgacagctctctgtacatgctgatgtgcacacacatttattagactcagattgcgacacgtaattcagggaggagctgaagact

SEQ ID NO: 204706 - DNA, 601 bp, Human
gctaatgctggaatgaagtaagccatgtcttaacgcacaaagggctgtgcctcaatgttgtcaggaaagctttctttgatactaaaagctaaagtcccagaatttaccacataaacttgctctgttcccaaaatattctcagtatcaaagtaactgccactttaaaatagaaaataagaacaataaatagtaatgggcaattaatccaacagagtataggctgtaatacacgtgttctaaaagcaaataaggaagaaagtctttgtcctttaaactgaaagtagttatggcaggagacacrtgtacaatcttacacctacaagtgttttctgcttgtagtctttatggttagcgagacggctggccctgcggtcatctaagttcatctaatgaatcttaaacctttgttttgctatagctaaatgacttataccaaaatgattaacatgctgaacacatgataaaaaaaatatatattcttcccttaagagacttcagagaaaaaggaaaaactttatgcaacacagaatttcagctgtccaaaaagtagcctcaaaaaagatgctaaagtcaaatgaactcacagcaaggattctaagca

SEQ ID NO: 204707 - DNA, 601 bp, Human
aaaaatactcagaagttagttaatctgtaaaatctctgaagagagtaaaaacatctactttaggctgggtgccgtggctcacacctgtaatctcggcattttgggaggctgaagcaggcgaatgcctgaggtcaggagttcaagacaagcctggccaacaatggtgaaaccccatctctactaaaaatacaaaaattagctgggcatggtggcaggcacctgtaatcccagctactcgggaggctgaggcaggagaattgcttgaacccagcaggtggatgttgcagtgagccgagatcatgccattgcactccagcctgggtgacaagagcaaaattccgtctcaaaaacaaacaaacaaaaatctactttaaaaagttagtgtgattctcaaacttcagtgagaccttctacatctaacaagctgatcaagtatcaactgctaatgctggaatgaagtaagccatgtcttaacgcacaaagggctgtgcctcaatgttgtcaggaaagctttctttgatactaaaagctaaagtcccagaatttaccacataaacttgctctgttcccaaaatattctcagtatcaaagtaactgccac

SEQ ID NO: 204708 - DNA, 601 bp, Human; identical to SEQ ID NO: 125292

SEQ ID NO: 204709 - DNA, 601 bp, Human
tgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactaccgtccgcgcgggcgcaccgagcccggcttggcgcgggcaacagaagttaggaggtctgcgtctgggtctcggctcaccctggggggccgcggccatgrggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtaggg

SEQ ID NO: 204710 - DNA, 601 bp, Human
tctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacggtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaacttagccggtcttggcagcgggcacctgta

SEQ ID NO: 204711 - DNA, 601 bp, Human
gcagcccatggatcaaggagtaatttcaactctcaaatcttacttaagaaatgcatcttgaggctgagcacggtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattwaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaacttagccggtcttggcagcgggcacctgtagtcccagctactcgggaggctgaggcaggagaatggtgtgaacccgggaagaggagcttgcagtgagccgagatagcaccactgcactcc

SEQ ID NO: 204712 - DNA, 601 bp, Human
atttgtctccaggcacggtggctcacccgtgtaatcccagcactttgggaggcgaagtgggcggatcacaaggtcaggagatcgagaccatcctggctaacatggtgaaaccccatctctactaaaaatacaaaaacttagccggtcttggcagcgggcacctgtagtcccagctactcgggaggctgaggcaggagaatggtgtgaacccgggaagaggagcttgcagtgagccgagatagcaccactgcactccagcctgggcaacagagcgagactccatctcaaaaaagaaaaaaaraaagaatatttgtgattcatgggaggaggtcaaaatatcaacatcagcagttcacggtggctcacgcctgtaatcccagcactttgggaggctggggcaggcagatcacctgaggtcaggagttcgagaccagcctgcccaacatggtgaaaccccgtctctaccaacaaaatacaaaaattagccaggcatggtggcacgctcctgtagtcccagctacttgaggggctgaggtaggttaatcgcttgggcccaggaggtggaggctgcagtgagccgagattgtgcctctgcactaca

SEQ ID NO: 204713 - DNA, 601 bp, Human
gcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcaggatttgaaaggattgactccaattttgaaagaagttccactgtgggtaaaatgctgtcacacagcattgcacgctacagagaaatctttcatgaaaggaagaga

SEQ ID NO: 204714 - DNA, 601 bp, Human
cacagctgccccaaccttcattagccactgccctgatccatgagcagccatcatcagggcaagacccttcaccagcaaaaatattacaactttgtgaagactcaaatgatcgttagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaat

SEQ ID NO: 204715 - DNA, 601 bp, Human
cttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatrgtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcac

SEQ ID NO: 204716 - DNA, 601 bp, Human
tcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatgggstttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtga

SEQ ID NO: 204717 - DNA, 601 bp, Human
ctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacrtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactat

SEQ ID NO: 204718 - DNA, 601 bp, Human
agtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtg

SEQ ID NO: 204719 - DNA, 601 bp, Human
aattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtsctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgg

SEQ ID NO: 204720 - DNA, 601 bp, Human
ttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagacttkgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggc

SEQ ID NO: 204721 - DNA, 601 bp, Human
ccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctstagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgc

SEQ ID NO: 204722 - DNA, 601 bp, Human
cctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttktgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaat

SEQ ID NO: 204723 - DNA, 601 bp, Human
catatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatccygtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgccca

SEQ ID NO: 204724 - DNA, 601 bp, Human
ctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatcyggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaa

SEQ ID NO: 204725 - DNA, 601 bp, Human
caagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcytgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcatgtggtctgaatgatcttgtgagtcctaaggtgatgtcgaggcacctcccacctctgttgaaaccaactagacaagtct

SEQ ID NO: 204726 - DNA, 601 bp, Human
ttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattwtttatttatttttttatttttttgagatggagttttgctctcgttgtccagggtggagtgtaatggcatgatctcggctcctctgcctcccaggttcaagagattctcctgcctcagcctcccaagtagctggaattacaggcatccaccaccactcccggctaattttttgtattttctagtagagacggggtttcaccatattggccaggctagtctcaaactcctgacctcaggtgatccacccgccttggcctcccagagtgctgggattacaggtgtgagctactacacccggcc

SEQ ID NO: 204727 - DNA, 601 bp, Human
cagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttwtttatttttttgagatggagttttgctctcgttgtccagggtggagtgtaatggcatgatctcggctcctctgcctcccaggttcaagagattctcctgcctcagcctcccaagtagctggaattacaggcatccaccaccactcccggctaattttttgtattttctagtagagacggggtttcaccatattggccaggctagtctcaaactcctgacctcaggtgatccacccgccttggcctcccagagtgctgggattacaggtgtgagctactacacccggccgatgcctggatt

SEQ ID NO: 204728 - DNA, 601 bp, Human
ccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcrcctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggt

SEQ ID NO: 204729 - DNA, 601 bp, Human; identical to SEQ ID NO: 26274

SEQ ID NO: 204730 - DNA, 601 bp, Human; identical to SEQ ID NO: 26275

SEQ ID NO: 204731 - DNA, 601 bp, Human; identical to SEQ ID NO: 26276

SEQ ID NO: 204732 - DNA, 601 bp, Human
cttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataayaataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaaca

SEQ ID NO: 204733 - DNA, 601 bp, Human
acctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagytgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcac

SEQ ID NO: 204734 - DNA, 601 bp, Human
tttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcgsggtaaccttccttaccagttccgccaggacctgtcgaatagtttgagtgcactgctttagctccagtagctctgtatctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattct

SEQ ID NO: 204735 - DNA, 601 bp, Human
tacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtayctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactt

SEQ ID NO: 204736 - DNA, 601 bp, Human
catgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcsgataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttag

SEQ ID NO: 204737 - DNA, 601 bp, Human
ttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagayggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgaccttgtgatccgcccaccttggcctcctaaagtgctgggattataggtgtgagccaccgcgcccggccttgggtcatgatttccatcatctt

SEQ ID NO: 204738 - DNA, 601 bp, Human
aacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccargctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgaccttgtgatccgcccaccttggcctcctaaagtgctgggattataggtgtgagccaccgcgcccggccttgggtcatgatttccatcatcttagacctgttggtgctgaggttt

SEQ ID NO: 204739 - DNA, 601 bp, Human
tggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccrtgttagccaggatggtctcgatctcctgaccttgtgatccgcccaccttggcctcctaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgg

SEQ ID NO: 204740 - DNA, 601 bp, Human
tgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctygatctcctgaccttgtgatccgcccaccttggcctcctaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgggtagctgggactataggca

SEQ ID NO: 204741 - DNA, 601 bp, Human
tgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgacctygtgatccgcccaccttggcctcctaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgggtagctgggactataggcatgcaccaccacgcc

SEQ ID NO: 204742 - DNA, 601 bp, Human
gtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgaccttgtgatccgcccacctyggcctcctaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtat

SEQ ID NO: 204743 - DNA, 601 bp, Human
taattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgaccttgtgatccgcccaccttggcctccyaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgta

SEQ ID NO: 204744 - DNA, 601 bp, Human; identical to SEQ ID NO: 84937

SEQ ID NO: 204745 - DNA, 601 bp, Human; identical to SEQ ID NO: 84938

SEQ ID NO: 204746 - DNA, 601 bp, Human; identical to SEQ ID NO: 84939

SEQ ID NO: 204747 - DNA, 601 bp, Human; identical to SEQ ID NO: 84940

SEQ ID NO: 204748 - DNA, 601 bp, Human; identical to SEQ ID NO: 84941

SEQ ID NO: 204749 - DNA, 601 bp, Human; identical to SEQ ID NO: 84942

SEQ ID NO: 204750 - DNA, 601 bp, Human; identical to SEQ ID NO: 84943

SEQ ID NO: 204751 - DNA, 601 bp, Human
ggcagcatggtgaaaccctgtagtcccagctactcaggaggctgagatgggaagatctgaggtgaggaggtcaaggctgcagtgagtcacgatggtgccactgcactccagcctggttgacagcgccagaccctgtctcaaacaaaacacaaacacaaaaacaaaacactctgaaaaataatttggcatgatcctatgatcctcacaattccactcctagatgttataccctagagaaatccaagattccaaacacctgaacatatgaccgtaatgtagtaacgggatgatttacaagagyacaaaagctaagcgtgtcactgtggcagaatggataaagtgcctcgtgctcacagacaggaataccacgcagcagtgaaaattaaactgcagtcagctgcaacgtggatgaaactgtcacggcgtcgaccaaaaagacacatgcacgccacacacaaaatacactatgataccatcacactaactccaaatccggcaaccaagctgtgccatttaggggtgcataaataattgctcacaccggggagatggcacagaaatgattacctttccaaaatgaggaaggggaaaggaagaaggc

SEQ ID NO: 204752 - DNA, 601 bp, Human
cctcccaagtagctgggaccacagccatgtgccgccacccctggctaatttttatattttttatggagacagggtttcaccatattgctcaggctgatctcgaatgcctgggttcaagcaatccgcccatcttggcctcccaaagtgctgagattacaggcatgagctactgcacccagctatacattatattttaataaagctttttttttttttttggagacagagtcttgctgtcgcccaggctggagtgcagtggcgcgatctcagctcactgcaagctctgcctcctgggttcacrgcattcttctgcttcagcctccctagtagctgggactacaggcgcctgccaccatgcccggctaatttttttgtattttttctttagagacggggtttcaccatgttagccaggatggtctcgatctcctggcctcgtgatccgcccgcctcggcctcccaaagtgctgggattacaggtgtgagctactgcacccagccaataaagctattttaaaaaaattcatgattaaaagattttttttacaagtcttctaagaagagaatttccttaactagataaagggtatttattaaagac

SEQ ID NO: 204753 - DNA, 601 bp, Human
ggaatgagatcctgtcctttgcagggacatggatgaagctggaagccatcatcctcagcaaactaacaaaggaacagaaaaccaaacattgcatgttctcactcataagtggcaggtagttgaacactgagaacacatgcacacagagaggggaacaacacacaccagggcctaataggggtgggagtgaggggagggaacttaaaggacgggtcaataggtgcagcaaaccatggcacacgtatacctatgtaacaaatctgcatgttctgcatatgcatcctttttttttttttttttwaaagaagaaataaaggccgggagcagtggctcatgcctgtaatcccagcactttgggaggccaaggcaggtggatcacaaggtcaagagatggagaccatcctggccaacacggtgaaaccccgtctccactaaaaatacaaaaattagctaattagctgggcatggtggcgcgtgtctctagtcccagctactcgggaggctgaggcaggagaatcccttgaacctgggaggcgcaggttgtggtgagccgagatcgcgccactgcactccagcctggcgacagggcaagactctgttt

SEQ ID NO: 204754 - DNA, 601 bp, Human
gcttctgctcagcaaaagaaactatcatcagagtgaagaggcaacctacagaatgggagaaaatttttgcaatctactcatctgacaaagggctaatatccagcatttacaaggaacttaaacatatttgtaagagaaaaacaaccccatcaaaaagtgggcaaaggaggtgaacagatacctctcaaaagaagacatttatgaggccaataaacatgaagaaaagctctacgtcactgatcatcagagaaatgcaaatcaaaaccacaatgagataccatctcacgccagtcagaagggygattactaaaaagtcaggaaacaatagatgctagcgaggctgtggagaaataggaaggcttttacacttttgctgggagtgtaaattagttcaaccattgtggaagacagcatggcgattcctcaaggatctaacaccagaaataccatttgacccagcaatcctgttactggatatatacccaaaggaatataaatcattctgctataaagacacacgtacaggtatgtttactgcagcactgcttagaatagcaaggacatggaaccaacccaaatgcccatcaatgatggactggat

SEQ ID NO: 204755 - DNA, 601 bp, Human
ctcttctcctccaaatgatcacaatgtctctccaaaaagggcgcagaactagacggaggattggatggacgagctgacagaagtaggcttcagaagatgggtaataaaaaaaaaaacaatgatgaactaaaggagcatgttctatcccaatgcaaagaagctaagaaccttgataaaaggtcagaggaattgctaactagaataaccggtttagagaggaacataaatgacctgatgaagctgaaaaacacagcaccagaacctcatgagtcatccgcaagtattaacagccgaatccacmaagcggaacaaaggatatcagagtttgaacaccaccttactgaaataagacatgcagacaacaatagagagaaaagaatgaaaaggaacgaacaaagcctccaaaaaacacgggatttcataaaaagaccaaacctactactgactggagtaccagaaggagacggggagaatggaaacaagctggaaaacacacttaaggatattatccagaacttcctcaacctagagacaggccaacatgcaaatttgggaaatacagagaaccccactaagacactccatgagaagatcaacccca

SEQ ID NO: 204756 - DNA, 601 bp, Human
caggagattgagaccatcctggctaacacagtgaaaccctgcctctactaaaaatacaaaaaattaggcgggcgtggtggtgggcacctgtagtcccagctacttgggaggctgaggcaggagaatggcgtgaacccgggaggtggagcttgcagtgagccgagattgcgtgccccagcctgggcaacagagtgagactccgtctcaaaaaaaaaaaaaaaaattaaaaataaaaagacacattacaaaaccagtgaactggttgtagaatttcattcagaaacacaagttgtagcagatrccatgcataaggttaaccttatgtgtcaacttgactgggccatggggcacctggacagttagtccctcatgattccaggtgtgtctgtgaggatgtttctacataagactaacatctgaattgtactgagtgaggcgagggccctccctactgctgagtgggtctcatccaatcaactgaaaaccaaagcagaacaaaaatgctgagtaaggggaactcctgcctgtttgagctggaagattggtcttttccagccttcagactctggctgaaacatcagctcttcctgggtcttgagtc

SEQ ID NO: 204757 - DNA, 601 bp, Human
agcaagagtctgtcaaaaaaaaaaaagccgggcatggtggctcacacctgtaatcctagcattttgggaggctgaggtgggcggatcacaaggtcaggagattgagaccatcctggctaacacagtgaaaccctgcctctactaaaaatacaaaaaattaggcgggcgtggtggtgggcacctgtagtcccagctacttgggaggctgaggcaggagaatggcgtgaacccgggaggtggagcttgcagtgagccgagattgcgtgccccagcctgggcaacagagtgagactccgtctcaaaaaaaaaaaaaaaaattaaaaataaaaagacacattacaaaaccagtgaactggttgtagaatttcattcagaaacacaagttgtagcagatgccatgcataaggttaaccttatgtgtcaacttgactgggccatggggcacctggacagttagtccctcatgattccaggtgtgtctgtgaggatgtttctacataagactaacatctgaattgtactgagtgaggcgagggccctccctactgctgagtgggtctcatccaatcaactgaaaaccaaagcagaacaaaaatgctga

SEQ ID NO: 204758 - DNA, 601 bp, Human
agacccgtcctacgagggctgcggccatcacgtccccgcgagcgccgcctcctggtggcctctgagtgggaggaccttccagcgcttccctcactgtcctcatgggcttcctgccctgagggaagttggctcgaagggcagagatcagaggtcgtgccaggggagcctgcctgctgccaagcccctctgcatctgccctgcaggacacccagctgccctcaggagtcaagaaccccccgcgtggcccagccccttctgttccttgggcaaccagggagggtgtcgccccggccgctgaccytgcgccccgggccctcactcccgacgcccgcccgagctgagtgcgcgatgcggcagaagatgctacgtggctgcaggaagcgctgcgcacacgctgcctctggcagccgcacagcccggctgtttccagccagtgcggcctctccacagcagccccagggaaaccctacgcctgccaagaggcaagcgcgcggcattttataaaaatggtaaggataaaaaaagtcggggatgttaatttaaaacaaaaaggaccactgttgtggagtcaatgttttctctccagaacgcgcatgttgaa

SEQ ID NO: 204759 - DNA, 601 bp, Human
tgtacaaatgggttcttgctatgtttcccaggctggtctcgaactcctgggctcaagcaatctggccatctcagcctcccaaagtgctggggttacaggagtgagccacggagcccagccttgtgaatattttctaagtgactttcagttcacatttaaacaactaaatcgttgatattttcaacatgcatttctgagcatgtactctgggccagggaatgctctgggccctagaacctaggatctacagataccacctgaatgggcagagcccctaccctcacggagccgaccagagagmgacggcgagtggcgtgacacagcctcccactgacaccgcagcagtgaggatggggcctgtgggctgtttggagtttgttttcaaagatggcaaaagccaggcagcagcttacgggggaggatggtgcatatacagttaatattctagggaccaggacacacggaaaaacgtaaaggtctaaaaatcaaattcatttcagaaaaaaatttttcaagaaagatccatttccctccacccaacatgaattaaagcagcacaacatacccttttctctaagttctcccaaaatatcctgaacgt

SEQ ID NO: 204760 - DNA, 601 bp, Human
tggaaacggggtattgatgtacattataaatattaattccataaccattcaaaataaaacgatgttattgaaatctttgtcgtgctttgggaaaacgttaactgaaatgattaaatatctttcaagtggaattgagatcacccgccactccagaaggcagcaacgtgagagtaaggaacgtgcccctccagccattcaccctggcacccaccgtgcccaacagcgtgactcagctggcacagagttcatttggtcacagagattagagatgccttcacctaaaattctgaagttggtgggttttttttttttttttgagatgttgtttcgctcttgttgcccaggctggagtgcagtggggcaatcttggctcactgcaacctccgcctcccaggttcaagtgattctcttgcctcagcctcccaagcaactgggattacaggcatgcaccaccacagccagctaatttttgtatttttagtagagacggggtttcaccatgtgggccaggctggtctcgatctcctgacctcaggtgatctgctggcctcagcctcccaaagtgctgggtttacaggtgtgagccaccatgcccagccta

SEQ ID NO: 204761 - DNA, 601 bp, Human
cgggccccggggtgccacaggagctgggggacgggcctaccttcacacctcgttccttccgcagcagcgtcctggaaggcgggatgggggtccggttccctgtggggctgaagacgctgggcgccgtggggcttctgaagggcgcctgcttcgggatgcctttgagtggggctggaggacggcaacagtcagggcgccagcagcagtgaccggcaaacgtcccccaccccctgagcccagaacgtcccaccctcttctaggctagcgccgcagaggggaagggccaaacccctggcgggcrgcgggcaggacccccaggatcccggacctcaaggagcaggggaacgcctggagccacgacctcacactttgccaagacaccaaacaaagacagcggcaccccagcccagccacaggatctcaccaggtggagtctctcaccagtgtggcgggggctgagctctgcctccttcctgtgcctccaccggcaggggcatgaagccaggcgcctgggcttgagggccgccctcccaagccttctccccctgtcccctgaggacactcctgaggcctacctacgctgttacccaccagcgcccac

SEQ ID NO: 204762 - DNA, 601 bp, Human
cagagatgtccagcagctgccaagacaagcacagccctgccttagtgacggcaccagggcgcaacgggccccggggtgccacaggagctgggggacgggcctaccttcacacctcgttccttccgcagcagcgtcctggaaggcgggatgggggtccggttccctgtggggctgaagacgctgggcgccgtggggcttctgaagggcgcctgcttcgggatgcctttgagtggggctggaggacggcaacagtcagggcgccagcagcagtgaccggcaaacgtcccccaccccctgagcycagaacgtcccaccctcttctaggctagcgccgcagaggggaagggccaaacccctggcgggcagcgggcaggacccccaggatcccggacctcaaggagcaggggaacgcctggagccacgacctcacactttgccaagacaccaaacaaagacagcggcaccccagcccagccacaggatctcaccaggtggagtctctcaccagtgtggcgggggctgagctctgcctccttcctgtgcctccaccggcaggggcatgaagccaggcgcctgggcttgagggccgccctcccaagcc

SEQ ID NO: 204763 - DNA, 601 bp, Human; identical to SEQ ID NO: 38715

SEQ ID NO: 204764 - DNA, 601 bp, Human; identical to SEQ ID NO: 38716

SEQ ID NO: 204765 - DNA, 601 bp, Human; identical to SEQ ID NO: 38717

SEQ ID NO: 204766 - DNA, 601 bp, Human; identical to SEQ ID NO: 38718

SEQ ID NO: 204767 - DNA, 601 bp, Human; identical to SEQ ID NO: 38719

SEQ ID NO: 204768 - DNA, 601 bp, Human; identical to SEQ ID NO: 38720

SEQ ID NO: 204769 - DNA, 601 bp, Human; identical to SEQ ID NO: 38721

SEQ ID NO: 204770 - DNA, 601 bp, Human; identical to SEQ ID NO: 38722

SEQ ID NO: 204771 - DNA, 601 bp, Human; identical to SEQ ID NO: 38723

SEQ ID NO: 204772 - DNA, 601 bp, Human; identical to SEQ ID NO: 38724

SEQ ID NO: 204773 - DNA, 601 bp, Human; identical to SEQ ID NO: 38725

SEQ ID NO: 204774 - DNA, 601 bp, Human; identical to SEQ ID NO: 38726

SEQ ID NO: 204775 - DNA, 601 bp, Human; identical to SEQ ID NO: 38727

SEQ ID NO: 204776 - DNA, 601 bp, Human; identical to SEQ ID NO: 38728

SEQ ID NO: 204777 - DNA, 601 bp, Human; identical to SEQ ID NO: 38729

SEQ ID NO: 204778 - DNA, 601 bp, Human; identical to SEQ ID NO: 38730

SEQ ID NO: 204779 - DNA, 601 bp, Human; identical to SEQ ID NO: 38731

SEQ ID NO: 204780 - DNA, 601 bp, Human; identical to SEQ ID NO: 38732

SEQ ID NO: 204781 - DNA, 601 bp, Human; identical to SEQ ID NO: 38733

SEQ ID NO: 204782 - DNA, 601 bp, Human; identical to SEQ ID NO: 38734

SEQ ID NO: 204783 - DNA, 601 bp, Human; identical to SEQ ID NO: 38735

SEQ ID NO: 204784 - DNA, 601 bp, Human; identical to SEQ ID NO: 38736

SEQ ID NO: 204785 - DNA, 601 bp, Human; identical to SEQ ID NO: 38737

SEQ ID NO: 204786 - DNA, 601 bp, Human; identical to SEQ ID NO: 28135

SEQ ID NO: 204787 - DNA, 601 bp, Human; identical to SEQ ID NO: 28136

SEQ ID NO: 204788 - DNA, 601 bp, Human; identical to SEQ ID NO: 28137

SEQ ID NO: 204789 - DNA, 601 bp, Human; identical to SEQ ID NO: 28138

SEQ ID NO: 204790 - DNA, 601 bp, Human; identical to SEQ ID NO: 28139

SEQ ID NO: 204791 - DNA, 601 bp, Human; identical to SEQ ID NO: 28140

SEQ ID NO: 204792 - DNA, 601 bp, Human; identical to SEQ ID NO: 28141

SEQ ID NO: 204793 - DNA, 601 bp, Human; identical to SEQ ID NO: 28142

SEQ ID NO: 204794 - DNA, 601 bp, Human; identical to SEQ ID NO: 28143

SEQ ID NO: 204795 - DNA, 601 bp, Human; identical to SEQ ID NO: 28144

SEQ ID NO: 204796 - DNA, 601 bp, Human; identical to SEQ ID NO: 28145

SEQ ID NO: 204797 - DNA, 601 bp, Human; identical to SEQ ID NO: 28146

SEQ ID NO: 204798 - DNA, 601 bp, Human; identical to SEQ ID NO: 28147

SEQ ID NO: 204799 - DNA, 601 bp, Human; identical to SEQ ID NO: 28148

SEQ ID NO: 204800 - DNA, 601 bp, Human; identical to SEQ ID NO: 28149

SEQ ID NO: 204801 - DNA, 601 bp, Human; identical to SEQ ID NO: 28150

SEQ ID NO: 204802 - DNA, 601 bp, Human; identical to SEQ ID NO: 28151

SEQ ID NO: 204803 - DNA, 601 bp, Human; identical to SEQ ID NO: 28152

SEQ ID NO: 204804 - DNA, 601 bp, Human; identical to SEQ ID NO: 28153

SEQ ID NO: 204805 - DNA, 601 bp, Human
ggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgayttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggcccc

SEQ ID NO: 204806 - DNA, 601 bp, Human
gctcatcctagggatactaagatgtgcagtaaatgtttacttttcattgatgtaatgagaaacctggaaagaaagctaattgttgatatttatctgtaaaatggactttagcttctacaattctttgacagatattagctcagtactagatatagagattcttcttccaggaggttcaattagagatcatttcccccaaatgcctgtgtggttgtctgcccataaccaaacttccttgacacactttttagaactaacagttgacagaaatacctcagaagaaacagtcaaggccttcccmgattttttccccaaccactgctctgagtcagttaaacagtaaatctgttgcctcttacctgaggtctccaggcattactcctcccttggaggtgaagtcgagcttttgaaggagaccaggtggcaaacatattggtaaagtaggatgaagcagtaatctgtgcatctgatattgctttactctccattcccaatggcatgctgcaacctcaaagaaaagaaaaaagaaggttatcacaaggacatgcttcagcctcagttatactgagcagcttccactgatattctagggctactgtca

SEQ ID NO: 204807 - DNA, 601 bp, Human
gtccatatatggatagaccacattttgtttatctgttcatcacttgatgaacatttgaattgttttcacctgtttgctattatgaatagtacttctatatgcatttgtatattagtttttgttagagtgcctgcttttaattcttttgggtccacacccaggagtagaattgctgggtctatgttaattctatgttttccttactgaggaactgccaaaatattttctacagtggctgccctatttcacattctcatcatcaaggaaggttccaatttctttatattcttgctaacacttsttattttcccgcttgacattttgtttttgttttttttttaatttagccatcctagcaggtttgaaatgctatctcattgtggttttgatttgcatttccctaataactaatgatgttgtctatcttttcatgagtttgttggatccttgtatatcttctttggagaagttccattgaagtcctttacccattttaaaatttggttgtctttctgttgttgagttgtaagagttctttttatattctgggatactaggccctttatcagatatatgatttgcaatttttttctcctatact

SEQ ID NO: 204808 - DNA, 601 bp, Human
gggctcactgcaacttctgcctcctgggctcaagcaattcttgtgcctcagcctcccgagtagctgggattacaagcgcatgccagcatgtccagctaatttttgtatttttagtagaggggggtttcaccatgttgggcaggctggtcttgaactcctgacctcagatgatcttcctgcctcagccttccaaagtgctgggattacaggcatgagttaccacgcctggccagcaggcttggttctttttttttttcttttccttttcttcttcttctccttctctttattttttttttttagaggcagggtcttgttctgtttcccaggctggagtgcagtggcacaaccctagctcactgcacccttgtaacaagaactacaagtgcacactaccacacctggctaagggttggtttcttgtaaggcctctctcgttggcttgtaggtgtctgtcctctttctatatcttcatgtggtcgtccctctgtgcctgtctgtgtcctaatttcctcttttgctttaacgcataaaagatattttcattaggttttctttttgagagaggggttcacattgtttattttagcattgtgaagac

SEQ ID NO: 204809 - DNA, 601 bp, Human
ttttttttttttaaagagacaagtctcactatcttgtccaggctgaacctcctgggctcaagtgatcctcccacatcagcatcctaagtagctgggactacaggtgtgagccatcacacccagctacttttgcttttttatcaatctgacaatctttgtcttttaactgaaatatttggtccattcatattacatatgattactgttatatttcaatttaaatataccatcttatcttgctatttttcctacctgttttatgtttctttatctctctttgcttgctttcatttaggtttgytgagtatattttatcctttcatattttttcttctaccattttgggagtcttacattgtgtgtatttctattacttactggctatcctataaactacaacattaatcaaattatgaaggtttaatattaacatctttacctcctagataatacatggattttagaatcctttattctatttatccacatgctgacttttttgctgttgtcatatgttctaaattttcacacgcacacctggcttaaacaatagaaatttattttctcacagttctggaggctacaagtccaagatcaaggg

SEQ ID NO: 204810 - DNA, 601 bp, Human
cttctgtgtcattcatgctgggagctgtagactggagctgttcctattcggccatgttggaaccacccttgtaattttgcaatttcaaggtgctattttctaaatatgtctataagatcaaacttgtgaatcatgttaattgttctatttctatacattgttccatcaattgacgagagatgtgttaaaatctagcctcccgagttcacgccattctcctgcctcaccctcctgagtaactgggactacaggtgtccgccaccacacccggctaatttttgtatttttttttagtagagayggggtttcaccatgttagccaggatggtctcaatttcctgacctcatgatccacctgcctcggcctcccaaagtgctgggattacaggtgtgagccaccgcgtccagccatgaaatcacattcttaatcttcagcaatactttcttgctttaaagtctatttttctgctatcaatagagctgtaatcgatatcttttagatatttgcataatttcttttcccatttttgtcttgctacttttctgtatctaatgttttagatatgactcataaaatgcacacaatttacttttgcttttt

SEQ ID NO: 204811 - DNA, 601 bp, Human
cttcaggccagtttctgtgttcttttcacatgatcccattaatcttctggcacatcaagatcaccaagatcatctaagattgcctggcagtttccttgatccagccttgaaaaagtcatttctctagggagctcagattcttttgactggaaaatggtagttagagaccaagatttgggcatgggatgggctcgttattactgcagtgtaattacttctagattccctcagtgaacagtgctaagaatatgattttttaaattcctaagttctcactgacacttctaattcaactctaacrttctttttgttagtattagatttctagggctactgtaacaaattcaccacacacttggtgcctttaaaacaaaagaaatttattcacttatcgttctagaggcttaaagtctggagcctggagcagaggcacaaaagagtgtgtcaaacacaaaatcacatttaaagcttctatttggaagtggtatatatgtcatgtccaatcacattctattgatcaagatgagccgtacggccatgcctaaagttgatgaggttttcaaggaaagagggaataaaaactcaagaacattaataccat

SEQ ID NO: 204812 - DNA, 601 bp, Human
tcgagtgctgggaggcgcgggccaggggacggggcgggagctcgggccgcttcttccagccgggaccgagctctgcgcctcgccccgccagggagggatgagggaaacctgtggaacaactttagttcgcccaacttgaaaacggaggtgaaattttgtatttttgctttattattatttttaaaggacttaaatctaaaaaagatccctcctgcttctgaaaggtggtgagaggctcctgctggtggcctgagcacggagtgagctcgaaggcttgagagcggcctctgcgcgccccgcrgactcttgtgcctgcccggcccgttagtttgagggcgggtggcagccgcgggagtcgcaggcaggtgctccgcaggttgaggttttaggatctggagcctctcacagtagcccgatggctctccataacccgatccagatttcccggggtagccctctacaggggggagacgcggagcccccagggcccagcgcacactgggttgatggggaaacgggttcccaggctgtccacactcgcaggactgtccacactcgcaagacgccagggatgcaggggtggtaagccagacgtggagat

SEQ ID NO: 204813 - DNA, 601 bp, Human
cccgccagggagggatgagggaaacctgtggaacaactttagttcgcccaacttgaaaacggaggtgaaattttgtatttttgctttattattatttttaaaggacttaaatctaaaaaagatccctcctgcttctgaaaggtggtgagaggctcctgctggtggcctgagcacggagtgagctcgaaggcttgagagcggcctctgcgcgccccgcagactcttgtgcctgcccggcccgttagtttgagggcgggtggcagccgcgggagtcgcaggcaggtgctccgcaggttgaggktttaggatctggagcctctcacagtagcccgatggctctccataacccgatccagatttcccggggtagccctctacaggggggagacgcggagcccccagggcccagcgcacactgggttgatggggaaacgggttcccaggctgtccacactcgcaggactgtccacactcgcaagacgccagggatgcaggggtggtaagccagacgtggagatgagactctcagaaaggtgctttgggcccttgctaacctctgaacttgagtaggtgggcctgggtcccctgggttctgaggtct

SEQ ID NO: 204814 - DNA, 601 bp, Human
gtccagatgtatattttaaaactaaaagtagttcaagtctattctgctgttttaagttagagaacactggactacatatatttatcagtatcatatgtttttctggcagtgttaaagaaagaaaacacatttttagatatataagctagcactcatagttaattctgtatatttaataatacctttcagtgcttgtcaaaaggaggggtttcaaaatgacagagcaatttctgtttgaaaataaatttttggcatcactagccatttttctctcttcgaaaacaaatatacaactggtaartacttgataccagtgagtagtatttttcttacatagttaatgatcagattttatgtttatattttttgaatctcattgtatctaaactagggaaaataggttgttaagcctgttaaatccttattaaccgtaatataaattattatgcaaaattatgtaaatcaatagatttcaagttgtgtgaagacagacacatttttgtgttatgcctttgaattcaagaaaacttatttaaagttaaatattttgggactgaatatataaaacttctaagtaaggaagttggaacaaagaatttca

SEQ ID NO: 204815 - DNA, 601 bp, Human
tttaaagttaaatattttgggactgaatatataaaacttctaagtaaggaagttggaacaaagaatttcaggtggaaaataaatacttataaaattttttagaaaacttctattaaatatttgaaaataggtatggtagatatctttcattattttttcctctttggcattattgtttgtatcctttcaaaattccagaatatctattgttagatgatctaaaccaccatgatacatggcccacaaattgctgctttacattgaaataatttttatcaaaatttatctttgacatatatakttttaaaattatgaaatgacatattgtgttttttctctaaaattcaatgggcttttcctaagttctaggataaattcaaaatattaactgtagtatttgttgaaatgttttgatactgtatttgaagttatctttaagtaattgtgataggaataacatttttgctttttgcaattagtctcacttctctttttattgcaaagaaagatttgatcagattttatcttgaaaaataattatatttcaattataccgcaagtacaatatcctgaattattttggcctataagagtaattgat

SEQ ID NO: 204816 - DNA, 601 bp, Human
tccatataaaaagatgagaaactgttttaagggtttgagttaattctccattcctcttcttttagtgattcacagatttagtcataaggagtctcatacaaaatttcaatagcattactacagttaaatatccttctactttattttgtgcaagccacatatcatgtgatttaaatgctagttatggtgaggtgcgctaaataaaggaacgtctttctctattctgaaatgtcaggacagaaaattacttctccttttctcatggagtttcttgaatttgtagattttatattttaaaaamacctagaaatgtaattgttaagatcatcacaaattattctttgcagagcagtacttttgtattgggtaggatggaagcaaattttaatttgtgcttattcctaactagttaaagagcgagttttgactgcactttaccccttcaaatgtttttccattgcttggttttggtacagatgaaatgtgtaaaaatttcttgattcttttggttttcttttagataaacacagttgagaatctccaagggaaactttttagcttcagagatctacttaaagaaaaaacctctcaaacatataat

SEQ ID NO: 204817 - DNA, 601 bp, Human
atataaaaagatgagaaactgttttaagggtttgagttaattctccattcctcttcttttagtgattcacagatttagtcataaggagtctcatacaaaatttcaatagcattactacagttaaatatccttctactttattttgtgcaagccacatatcatgtgatttaaatgctagttatggtgaggtgcgctaaataaaggaacgtctttctctattctgaaatgtcaggacagaaaattacttctccttttctcatggagtttcttgaatttgtagattttatattttaaaaacacmtagaaatgtaattgttaagatcatcacaaattattctttgcagagcagtacttttgtattgggtaggatggaagcaaattttaatttgtgcttattcctaactagttaaagagcgagttttgactgcactttaccccttcaaatgtttttccattgcttggttttggtacagatgaaatgtgtaaaaatttcttgattcttttggttttcttttagataaacacagttgagaatctccaagggaaactttttagcttcagagatctacttaaagaaaaaacctctcaaacatataattat

SEQ ID NO: 204818 - DNA, 601 bp, Human
gttttcttttagataaacacagttgagaatctccaagggaaactttttagcttcagagatctacttaaagaaaaaacctctcaaacatataattatacttctgattgatataaagtcaaatacagtacttcccccaactcccaaccttttctccccctcagaaaaacatcgggcaatctgatttggtagagtgaatagcagaaaaaaaaccaatatatttagccattaaactagagttcagctttaacaggaaagattgtcactaccttgcattagcattttttttcaggtcttgctctcmgcctcatagaaggctcacacatcttgtgattatttatttgttttgtaaaatgtgatacgtaaaacacactaatattgaatatggtcattattatactgcttaagcacagtaaaatggatgtatgtatttcactcttagggatcttttctttcatattttcccatattgaatcaattttccatttcttctaactaaaaaaaaattcattatgttaaaaatatgcagtaaaataataatgtcccagagctcttgaaaacctttatattggggcagattgctttttttttttttttttcggaa

SEQ ID NO: 204819 - DNA, 601 bp, Human
gatttggaacagaacactgtgttaccctcctcatcttacaaaaagcacatcattataattacactctatacttatatagtatcttctacattttgcagactttccaattcatattggaaaactgtggttcctggagatgaagttattttgtgtgaggtcatagcagatatgtagcagaagtggggaaaaagtggagcctcttgattttggtatattcattctcttctaaacagtacaacttttctcctgcctttattaatatgcttactgggtccatatttactttgacatagaaagccaygcagcaggtgttaaaatacaatatgctgagtgtacaaaatgtcaaacattcagatgaatcctggcgaatgtagtcaattattgcagtattttcaaatgttcacatttttggcatggtgaatttgaaaaattgaaaagcacattgcctccatcaggagtacagcattacctgtattcagtagccgcttgagatatgagatgacgtgtacagagaggaagtcttattttcaagggattttacttttgatccaggagacttctcatattgagaataactatattctccagggaaagggaggca

SEQ ID NO: 204820 - DNA, 601 bp, Human
cagagaggaagtcttattttcaagggattttacttttgatccaggagacttctcatattgagaataactatattctccagggaaagggaggcagcatggttccgtctcctctgagatgaaaacaatgtcagaaaacaagctgggggcaagggcacattgctgttagcaaggggtgctgactcaacattaactggccctctcagagttttagtgggtagccccacagacttctgtctctgcgaagtggggctctttatggagctctttcatttatttcaaaaatgtttacctggctgggctyggtggctcacgcctgtaatcccagcactttgggaggctgaggcgggcggatcacctgaggtcaggggttcaagaccagcctggccaacatggtgaaaccccttctctactaaaaatacaaaaattagccaggtgtggtggtgcacacctgtaatcccagctactcgggaggctgaggcaggagagtcacttgaacctgggaggtggaggttgcagtgagccgagatcgtgccactgcactctagcctgggtgatagactaagactccatctcaaaaaaaaaaaaaaattaataaaacact

SEQ ID NO: 204821 - DNA, 601 bp, Human
cttaccatgtgctggacacttttgggagcagggttgataagtggtgaacaagacagatgagatgaaggcccttctctcgtgtagtttcctaactcatataatctggactcctaggagtgagtccctcagctttggcctggtatatttaaagtagtcatagaccattaatattaacatatgtacgttgaaatgaggatcacttgagtacattgggaggctggggaaagtggggcctgtaatttaaggaaggctttattgattttgaactgaataacacagtactaaatggaaggaatggaaytgagaaacagcctaagagaaaagtaagggtgacaaaaatattgacaagttttttgtttgattgttttcctggctggaggagaggacatagtgaaggcgtgttgcagtagggttcatggatgggggaaattcagccctaaaatataggtatagtgtgtattatcacactgttaagaaatctactgtaatatgccaattgtattgggaacatggaattaaatgcttaggtttgtcttatggaaatcttgacaaaggagggagtagcactagaaggagaaaaagataagtgggaggttcacca

SEQ ID NO: 204822 - DNA, 601 bp, Human
ttttttgtttgattgttttcctggctggaggagaggacatagtgaaggcgtgttgcagtagggttcatggatgggggaaattcagccctaaaatataggtatagtgtgtattatcacactgttaagaaatctactgtaatatgccaattgtattgggaacatggaattaaatgcttaggtttgtcttatggaaatcttgacaaaggagggagtagcactagaaggagaaaaagataagtgggaggttcaccagacaggcaagcacacaggggtattattgtcagacagctgtgggctactygagctgcggtcattgctgagttaccatgagggcatctggaagctgaatgaggaagacatggaaataatctgaatatagagtcctggaagttcgttgagagaagggattgttaccaaggggcaggatcttggcaatggattaggaggagtgtttcatatatgacagtgaaggatctgcaccagcatctccttactgggctctgtgttaatcaaaggcacacatttgcatgttagctgactcaggttaaagtgttatctctagtcttagagcagagaaaatgtttgtttgttccaaagatgg

SEQ ID NO: 204823 - DNA, 601 bp, Human
tggaggagaggacatagtgaaggcgtgttgcagtagggttcatggatgggggaaattcagccctaaaatataggtatagtgtgtattatcacactgttaagaaatctactgtaatatgccaattgtattgggaacatggaattaaatgcttaggtttgtcttatggaaatcttgacaaaggagggagtagcactagaaggagaaaaagataagtgggaggttcaccagacaggcaagcacacaggggtattattgtcagacagctgtgggctacttgagctgcggtcattgctgagttacyatgagggcatctggaagctgaatgaggaagacatggaaataatctgaatatagagtcctggaagttcgttgagagaagggattgttaccaaggggcaggatcttggcaatggattaggaggagtgtttcatatatgacagtgaaggatctgcaccagcatctccttactgggctctgtgttaatcaaaggcacacatttgcatgttagctgactcaggttaaagtgttatctctagtcttagagcagagaaaatgtttgtttgttccaaagatggattaatctagatcttttcttgattg

SEQ ID NO: 204824 - DNA, 601 bp, Human
atagaccactttagaactgaggtgaaataaagccttatggaatcattgcaacccaggtttgaataggaaatgaggagcaccactttttaaaccatgtctaataattgctctttagtttggatcagatgtcaaattattaccattgtaaaaacttgataagggaaattcaagcaaggctgtttccgatgagtagtgttagtttactttctaggaacagggccaagaagttgtactttttaacttaaaaaaaatgattcatgctaatgagatactgtcactgacatgttgtttgaaataaaawgaggctcacagcctccggtagaatcaaaactaagggagttatctctgcatcaggtttagttaactttcataaaaagaagaaaaaaagacacatcctatatcactattgactgattaggtttggagtatgtgtgtgtgtgtattcattcttcctttttctcatttacttatgcaggtccactatgcaattaaagttttcctttttttctagttagaatcaagaaaaatgtgaacatgatgatttacctgtatgctctgaattgcatctttcttcttatgtaataatactttttttttttaa

SEQ ID NO: 204825 - DNA, 601 bp, Human
tttcatttatcttacttttgtattatatagatgctgcataacttttttctgatcaatttaagtagaaagtatggcaaagtgatagtgtactttgtaaaccctcaacatatttatttaagaaacttcaaagagaaacaaagggtgtgcactgttttactatattggctttctgagttttggctggtttcccaaatagcaatttttatatttaaaaaaaaagacagacttaactgcttgcagacttttcacgcatggaagatgaagaaagcttcttttgatgaagtgtaattatgtccaaacrgagctgaccccctccccctatatttcttatgatcttaactgaagaaagtaggatttttcctttgaagcagccgggacttggtggaggatctgaaatgctacagtctgctgccagaggcaggatggagaaattggtccagacttgtcttcaagacttagatggggggtagggggagtgggtggagagagaaagaaaaattgatttatcactaataatatatttttatatcactgcattaacattgtatgaaaggaaacagtaatatcaagctgagatgaagaggaaaaaaggacagagaac

SEQ ID NO: 204826 - DNA, 601 bp, Human
gccatagatgaaaactgactctgaaacacagccatgggagccactgttagaaaggcaatcctgggcccatagaccactaatctgaccccaaaatggcactttaaaatgttttagtgtaaattaactttcaatctagagattcagctcttttactttttgcgatctttccattgttttgaggttctaacttggacccagtggcttcctattcaagtttctggtttctaattctgtaggcttttagttttctgtaactagtttagactcctggctggtttattcttctggttagtcttaacgyttataataaagcctctctttgctaaccaattataaattatttaaatccgtgtaatagccaatatagtggataaaatatatcaatgacactttaaaaatagatgctttcatcatcctgagatattgcattagtccatttatgtttactgtttcttgggcacatagagctgattgggacgcatctagaaataaattacttattaatttttttaaatggcaagtgatcaagccacttaaggaagtggccaagtgacagaatatttaaaaaaaaaagagcattaattttagggtctgaaaaatg

SEQ ID NO: 204827 - DNA, 601 bp, Human
aatgcacaatatttccaattttcttaaacagtgagtataataggagtttgattagttggtgcatataatgttaaatgggagatcctctagaacacagactggcacacgttttctacggagtgccagatagcaaatcctttagactctgtgggccgtatggtggtctctgtcacaaccactcaactctgccattgtagctcaaaagcagcataagcaaatacatacattcatggtcatggctatacaggttgagtatcccttatccaaaatgcttgggaccagaagtgtttcggatttcaattttttttttttaatttttggaatatttgcgtatataatgagataccttggggatgagacccaaatctaaacatgaaattcatgtatgtttcatatacaccttatgcacacagtttgaagataattttatacaatatgtaaataatttcgtggaagaaacaaagtttgtgttatgtacttatgtgtggaattttctacttgtggcatcatattggtgctcaaaactttcagattttggagcatttcggattttcagattaaggatactcgatctgtattccactaaaattttacttataaa

SEQ ID NO: 204828 - DNA, 601 bp, Human
ttagttggtgcatataatgttaaatgggagatcctctagaacacagactggcacacgttttctacggagtgccagatagcaaatcctttagactctgtgggccgtatggtggtctctgtcacaaccactcaactctgccattgtagctcaaaagcagcataagcaaatacatacattcatggtcatggctatacaggttgagtatcccttatccaaaatgcttgggaccagaagtgtttcggatttcaattttttttttttaatttttggaatatttgcgtatataatgagataccttggkgatgagacccaaatctaaacatgaaattcatgtatgtttcatatacaccttatgcacacagtttgaagataattttatacaatatgtaaataatttcgtggaagaaacaaagtttgtgttatgtacttatgtgtggaattttctacttgtggcatcatattggtgctcaaaactttcagattttggagcatttcggattttcagattaaggatactcgatctgtattccactaaaattttacttataaaaataattggtgggccaagttgtagtttgtcaacccttgcttattcaaagtg

SEQ ID NO: 204829 - DNA, 601 bp, Human
aatttgtaagtcttgtgtttaggcaaggcattttgaccttctgttggcaagctagctctgaagaacaactgtcagccggagaagtggtgtagcagcagcagcaatagtaatgcatttagatacctagctctttgaaacatcggtttctattaggatcccttgttccatctgtggacttggttccacctccagtctgatttaaataatttctacaggaatgtgaaaacttggttagcaacatcatattctatagaagtggttcagagttagggaagaggactgatgggagaaggtattattygttgtgcagaggatggaaaaagtaaataagcttacataggatactttaaattctcttgctgtattttttagttgtctattactaaataataaactaccctcgaatataacatccagtttattatttcttatgattctgtgggttgattggggttcatctggatggtttttctatttgtcaggcttggggtctatcatgtagctgcaatcagatagtggctggtgctggaacatcccacatgcttcatttatgtgtctgatgccttggtgggatggctgcatggttgggctcagctggaat

SEQ ID NO: 204830 - DNA, 601 bp, Human
cttgtgtttaggcaaggcattttgaccttctgttggcaagctagctctgaagaacaactgtcagccggagaagtggtgtagcagcagcagcaatagtaatgcatttagatacctagctctttgaaacatcggtttctattaggatcccttgttccatctgtggacttggttccacctccagtctgatttaaataatttctacaggaatgtgaaaacttggttagcaacatcatattctatagaagtggttcagagttagggaagaggactgatgggagaaggtattatttgttgtgcagargatggaaaaagtaaataagcttacataggatactttaaattctcttgctgtattttttagttgtctattactaaataataaactaccctcgaatataacatccagtttattatttcttatgattctgtgggttgattggggttcatctggatggtttttctatttgtcaggcttggggtctatcatgtagctgcaatcagatagtggctggtgctggaacatcccacatgcttcatttatgtgtctgatgccttggtgggatggctgcatggttgggctcagctggaatgatgcaacagc

SEQ ID NO: 204831 - DNA, 601 bp, Human
attttcttttcctgtttgcttattctcagttgtgcccaattcatcaacaaatctgtaattgttcagagaagttttatttctctgtatttttgaggcatgtccaattgcagaagttttaccttaacaaacttgagtgaacagacttaacgaaacaggtggtgtaggcaagacatcatctcatttttctcttacgctgttccacctagttctgggactgctttccagcctggtgaagggtggagagaatggaggggttgacatttttctcttcctcattccagctgatgtcagcggcagctcrcttttatcctccattacttttcatcttagttgggtgaaggaatagactttttatgccaaaggctagcccatgacttttgcttatttaccaaaagaggatgcttattttattttattttatttcagatggagtcttgctctgtctcccaggctggagtgcagtggcgggatctcggctcactgcaacctccacctcctgggttcaagcgattctcctgcctcagcctcctgagtagctgggattacaagtgtgtgccaccacacctggctaattttttgtatttttagtggagacgggatt

SEQ ID NO: 204832 - DNA, 601 bp, Human
gaggggggcggggggatgggtcagaagcgctggtggaggttatgtctggtggttggtggaatgtgctcttgagaagaccagttttaaatatctttcagtcctttttttttgttgactggctgtcaggagctgggaagatagccaagaaggaaatgacacatcgagaggcattttgtgttgtgcaacattctgtggaactgatgcaaggatatatggcctgtttacacattccttcgctcgcagactgcatggcagtaatttaattcagcagcacatggcatgctgcagcaaggagctatgscattaacatcctttcatggcaaattatcacagccgttaaaacatgctcgtgtccctcctttgcactcttccctggcttcccagctctgaatatgcgttttcattgtattggacttgtgttaacaaggtgctgtagctttcacagcaagagcacagtttccacatgcatatgttccagttgatatatttacttctaactaaatatagcatggcaagttttcaagtgatatgtgttctaaaaacacatacatgcttgatccaaatgtgtcagtagtttgtatcttagtgtaagtcagagatc

SEQ ID NO: 204833 - DNA, 601 bp, Human
agggtagtttgtgtttaagaggtggattcccttatggctaaggggattggaggactcaggaattcttcttttgagacctcattgccatctttgtgaccttaagcaaaccactaaacttttctctacttctatttcttcatctttcaaatggaaatagacatgaaggcaacttcacaaagtagctgggagtaactcctaaggaatgatcataaagtacttggcacacatgaagggcagcttaaataccaattagtaattatgtagcgcctttctgccaaggagttccaaatgcttagacatyacctcagtgattctctgtacatctctctgagggaggcgttatgcattttacacataggtaaactgaggcatggacacctgagaactcatttgtcctatgttactctgcaagtcagcagatgatttatagagacaggcaaggattccagatattttcctgtttatcctgttgccgtttgtcaagtctgtgtaagtgttgggcccaggggattcttggttgatgtgatgaagcagtgttacataagaagcatgcttaatgctgcagtagcatcgctgaatagtacagaagtcaaagttataa

SEQ ID NO: 204834 - DNA, 601 bp, Human
aagcatgcttaatgctgcagtagcatcgctgaatagtacagaagtcaaagttataaggcctggcacagagtgggcatgcagttcatggacataggcatgtttgttgaatgagtattgaattcattttaacagctgaaaacactgaattttgtgagatgaaaataatacattgtataacttaacctcaatagaatcttactttgaataccagtgaaatgaatttagtacttaaaaaaaattaactttaaaaaattgcacaagtgaaaaaattgcacactagaaaataaaaactaataataamaaagaagaagacagagatcactcataattgcatctcccaagattaccactactaacatcgtgatgtgtatctcccagatattctgtgatagataatgctggtactgttatgaaagataacagaagttggggaaataacatcaggaaaatgatggaatgctacagaatggcatgaccacattgaagctcaaaggagagcgaataactggaaatgaggataattgctgtaaggaaaaggagcatgacaatagaaccgacaattgtttccagttaatggctgcctctgtgatgtgaagggcct

SEQ ID NO: 204835 - DNA, 601 bp, Human
tttaaaatgtaaatatttccggcatgggaacatttattcattcaaaaaattacttttgagtgcttactgttagccaggtgccaggcaggcgtgatcctccctttgaggagcctacattctgtagagaaaaaaggcaagaaacaagtaaacaaacatttctctataatcacatctaattgcaaattgtgataagtgctgtaaagggaactgatgtcatagtaaagagtaatggagtgggagggaacaggatggaacctattgaagagtggtccaaggaaggcctgtctggggagatgacatyggagcacagacctaaagggtgagaagaagccagtttgaggaagagttgggggaagagacatcaaggcaaaaggtacattgtgtgcaaaccttgaacacagtcagtatcagaatctaatatctaattttgcaaggtgagagggcattagcaatgcctacatggttgggaagaggttgcaaaaaaagtagactggactcacacacccaaaagtggctgtttataattgtacccaaggctggtgtggtgtaattagaggagcacaaaaggactcttcatgttcatccctcctggccccaaacc

SEQ ID NO: 204836 - DNA, 601 bp, Human
tttttggtgaacaacttggtttaaataagtgaatcaaatcagattagctagatacttattttatagcagaggaccacaagacccaaattggtagggaaagcaggttgagaaagaccttgaagagctctggtgagaaaaatcgagtgggaggaggtggagggggaatggcttgtctgtagctggggctccgtaagaattctgggtcccgaataacatgttttcttagatgaagagcaataggagtgggcttgtactaaaaataacccaaacaaagctgtaggctacctatataagtagattstcttaggactatgtatcatgcagtaaagccttggcttatgtggacaatgagaagcaatcccgaaggtgatctgggtttcaaaacataagagcaacatggaaaacttcagaatgtttagcgaagagcattgatgatgattaaaggcttgtaaaattgaacctatgaggataagttgaaagacttgggatcgtttagcttcaagaagaggagactgaaaaatgacttaataacagactcaaaattatgagagttattaagctatgtatggtgaccagctgttttgtttctggcaaggtcaga

SEQ ID NO: 204837 - DNA, 601 bp, Human
atgcagtaaagccttggcttatgtggacaatgagaagcaatcccgaaggtgatctgggtttcaaaacataagagcaacatggaaaacttcagaatgtttagcgaagagcattgatgatgattaaaggcttgtaaaattgaacctatgaggataagttgaaagacttgggatcgtttagcttcaagaagaggagactgaaaaatgacttaataacagactcaaaattatgagagttattaagctatgtatggtgaccagctgttttgtttctggcaaggtcagagaaagaataggtttcaamtgaattaggttagatttaaagaagaacttcttgactataagaattgttaaatagtacaggttgctgaaggatgagggcttgaatggagggcttttcaaataccttccattttagtgattctctgtgtgtttataaagtgcaacaaagtgccacctttctgctttcaaaatcaaaggcatgatttctgttttccattataattctgaagctcagactcgcagaggtttgtggacataaataatgagggtaatttgtcttgactctgtggccattagaatctttaattgagaaaaatatgac

SEQ ID NO: 204838 - DNA, 601 bp, Human
gaaacagagaggaaataggcaggatttatttctgaaaacagaaaccttcatgcatttaaagactggcagagaagtgaagttgagcagagcaagtctgagaaaggctggctgaacacaccattcctttcagctttggagctggagctgcaggaaagaaagagccctgttttcagggttaacttttcttggagaagccaagcatcagagtttgtatttttaagtttattttttaattcattcttttgcttattaaatacctgtctgagcaacttttgtaataattaattagtacacctgcacrtggtttgctttaagcactcactgatagctcattgatgaaacgatgagaaacaaagcatgtacacacacacacagacacacacatgcacacgagcacagtgttttagatgagttcttgttttgaactaagtgcatacaattttctctaagggaaaaaaataatcaagagaccaaagaaacagacttcgaaacaggtgacacaacaaggaagaaggctgagtgggtgtggtgccaggctaggggaaaggaaaaatactcagaaagcctatttttctttcctcccaaaataacttgggctcca

SEQ ID NO: 204839 - DNA, 601 bp, Human
gagtgggtgtggtgccaggctaggggaaaggaaaaatactcagaaagcctatttttctttcctcccaaaataacttgggctccatggctcattaagaacatttagacccttagccactacactttacccttccaaagcaccatcactggtggagaaccacccacagttgaagatgggtcagaagtcacaacttgctttcttccactgccctcctttcttcattgtccatgacattttcttagtggtccttggcacttctgatgtccttcttatgatttttacatttgggtctcccccaccyctccccccaagatgatttattttcaaacctcttctaaagatttgtaaaagctacagctgtctcttcatgggaaaagccaacctaaaggggattagtggccctccttttttgctgtgaggccacaggattgatagtgggaaggaaaatcagctggagagaggtttggtttcctcctgttgtttatctttataaaaaagaaccctcttctcaaacacgttgctataggaaaggtctcttcattacctatgtggggacagtggagggccagttccatattttctgcagtaactgaggctggct

SEQ ID NO: 204840 - DNA, 601 bp, Human
gctttcagtggtcagggctttctagaaggctggacacatggccatgataatgcctaaagcacaatcaagaaggatggaggcttttatgaaggtcttgagattcaaagggaacaaaagtggatggtttggagagtgtgtcagtgaaggtcctgtgctttgatcatgtctcaggagattccccacattgactctctttgggtatttatgaaagtctacattgttggcacagatctgatatagcaaggaaatttgctggggccagggatccaagagtttttggattgtataattaggaaagcaytgatggtccaaaacgcaggatgaacattcattttattttttacagaacatatttttgtcccctttctgtatattatatattggttctatattttgtgagacctggtgcagcagttccttggtagagccaaatagcctgaatgaagagaaggagagatgcctcttcctttgctttcattctagattgtgttggagctatgctgaggatggtgaatagagaaactgattgtagttaatttgtcacctcgtagcccagtggtagcatttgaatggaagtaagttaatggaaaaggactttgca

SEQ ID NO: 204841 - DNA, 601 bp, Human
gcctcagaagacaactcatatgaagtgtacattcttctccttgcttttcttcttgtctcttttttccttttatctctgttctgttttataggtgctcacaagatgtttggtatgctaatcgaataagaatatgctatgttgggcactctaagcatgctttgagggtctcttgggtttcctcttcagacttcctcaaggctccatctctttatgtcatcttttggagtggcttatgtataccttagcaaaggatgctcagacctgccctatgggctgggttttcagaaaataatatattctrtatttgcatagcatacaaagtttgtaataacattgatgacttcacaacaactctgtaaagcagacagagaagatgccctttttcaagtgataaagaaggctggagaaattagagaacttgcccaggatcacacatctgtgttgaacatttcatatttgaaattggttagtatgattcaaatcaaattcaagttgaaaaaaggttcctgctgtgaatttgaagaaaaatgtgtaagatgtcactattttaccacatccaaaataatttcagattactctaactagaagctagccaattttt

SEQ ID NO: 204842 - DNA, 601 bp, Human
tgaacatttcatatttgaaattggttagtatgattcaaatcaaattcaagttgaaaaaaggttcctgctgtgaatttgaagaaaaatgtgtaagatgtcactattttaccacatccaaaataatttcagattactctaactagaagctagccaatttttatatgcatttttttgggaggagggggcaaaagtaagtaggaatcagatacatgtgaagaaaaaaaaattcaaatcaattttgggggttacatagttgtagtttttgttctgaattgctctggtggaggatcaaagaaaagcrgaattaatggagaaaaagagatatgtagaaaaaaagaaaacattgcctttttagtgtagcagcttgttcattactaaggatggaagggaaaggtaatgcttaacctttcccaacagaagaaggctgcaagtcagggcagggatggctgaatcagcaggtaaggtagttcttttttcctcctggaccatctccataggagatagggtgactggagaagggaaggtggaaggaagatcccatgtcagacaatgctttttcctatttttggaattctagaaacatgaaagatgagaggatgta

SEQ ID NO: 204843 - DNA, 601 bp, Human
ctggtttggaacagaggatgaatgttggggagaagaggaaaatcacattgaataggtagaatcaggctaatgatgcagggctgtaaaagctattcagaaaagtctcagttaatggagcaggcagtagggtggcctcatgaactccccaacaagatagttgaagggagggctttggattgccacctgacagggaattacagggactggatccattctacctctgtccacagaagtgctccagtgttgtgaagcaacagagatattttgatttggtggggaaaacaagaggaaccaaatatamggaagacgtagaagggaagggatgtatagaggcaaagaagccagctggaaaagtactcgcacaaccccagtgtgatgagacccaggaaatatatatgccatttaaagtcagtatcaacatcatggagaaggaaagtgcaaaaggaaggaatgtcttaagatggggaaacactcatgaaatgagtctgaagtcaatcgacaagaatattaagcacctactatgtaccattgctgttcttggcactagtctgggcactcttctaagctctgttctaagcatggactacaaacatgcttaagg

SEQ ID NO: 204844 - DNA, 601 bp, Human
agaaaaatgttcacaacatcagccgggcacggtggctcacgcctgtaatcccagcacattgggaggctgaggcaggtgaatcacgaggtcaggagatcgagaccatcctggttaacacagtgaaaccccgtccctactaaaaatacaaaaaattagccaggcgtggtggcaggtgcctgtagtcccagctactcaggaggctgaggcaggagaatggcgtgaacccgggaggtggagcttgcagtgagccgagatcacgcccctgcattccagcctgggcgacagagcgagactccgtctaaaaaaaaaaaaaatgtttacaacatcagagacagtttggctcctaagtgatcatttattggttctctgtgtatcagggactgtgtcttttcacccttatgtgcaaggtcccagcccagtatctgtcaggtagtagttaacagtaaagttttcaaatgaataagtgaactgttaattgattgctaaacccaagacatttataccctaaatataaacttttttttttctttttagtgatgatgggctagaatgatgacatgagaataatgtaaagtgaaatacaaatcctttacttcttttt

SEQ ID NO: 204845 - DNA, 601 bp, Human
taaagatgtactctgccttcaaggattttacgtagaactgggaagttaagcatctgccagaggagattacaaagaagtgtatgataaatgtcacatgagtgatacagacaagagtaccacagatttgggggatgagatcactgtggaccctgatactcagaaaaagcaacctggcctccatgtgagtccaagattgtcttttgatcagattgtcctttctttggtaccggaaatacttctcctggtctctatgaggttttcccttgggactcagaaactgtgcctttttgtagcaccatgrttgggcattaaaatgtctcactaacaggcctgtttccccttgtaatatatttctctgaagacatgcctcaaactcttgtagctcttatacttgttagctcaagactctggcgagtcctgtggcttttgtgagggcaaaaaagtttccatagaaattaaactgattcattttaacccatttcctctaccactctgtcccagagaaattggcttagactttgtggattcaaggccccaaatttgagatttgacaaaagcttacataataatggcattgtgggaataataacggtatagcttt

SEQ ID NO: 204846 - DNA, 601 bp, Human
agactctggcgagtcctgtggcttttgtgagggcaaaaaagtttccatagaaattaaactgattcattttaacccatttcctctaccactctgtcccagagaaattggcttagactttgtggattcaaggccccaaatttgagatttgacaaaagcttacataataatggcattgtgggaataataacggtatagcttttcagttttgctagttagagccaagatgatagaaagccaacccaggagccatcttgggacgtggacacttgggggttgggaatgggggtggaaaattactacygcattttttcccattctttttagcaaaggtgcctcaacttttaaatttgataaagtgatttccactcattgatgtcaccagatttgttacattaaaaagtaggtccagaacaaataagttcctggttgtaaggagtgtgtatgacttcctaacaaagtgctagcgtttgggagatatttatggatataagtcagggaatcatcctctttctaagttcctgaaaagcagggtgttttgtgcatattttttcctgtgcatgtagaactcaagtggtacctacatccctcgccccagacattt

SEQ ID NO: 204847 - DNA, 601 bp, Human
gagtgtgtatgacttcctaacaaagtgctagcgtttgggagatatttatggatataagtcagggaatcatcctctttctaagttcctgaaaagcagggtgttttgtgcatattttttcctgtgcatgtagaactcaagtggtacctacatccctcgccccagacattttctttctttctttttttttttttttgagatggagtctcgctgtgtcgcccaggctggagtgtggtggcgcgatctcggctcactgcaagctccgcctcccaggttcatgccattctcctgcctcagcctcccsagcagctgggactacaggcgcccaccaccacgcccagctaattttttgtatttttaatagagatggggtttcaccttgttagccaggatggtcttgatctcctgacctcgtcctcctcggcctcccaaagtgctgggattacaggcgtgagccaccgctgcccggccaacattttcaaagctatttaaataggataatcatgaagacagtgtcctattattccatcaaaatcggaagttaggtattgtctattaatggttaatttctcagatttaccttccttttctctattaagcgctg

SEQ ID NO: 204848 - DNA, 601 bp, Human
ttagccaggatggtcttgatctcctgacctcgtcctcctcggcctcccaaagtgctgggattacaggcgtgagccaccgctgcccggccaacattttcaaagctatttaaataggataatcatgaagacagtgtcctattattccatcaaaatcggaagttaggtattgtctattaatggttaatttctcagatttaccttccttttctctattaagcgctgagtttttcctttgaagggcatatagtagaggctggtcttttttctttgatagagccctgtttttgttttactgttttarccagtatactattaaagttaaactttgatactgcttatgctttaagaaaataaatctgatgaatgaaggtaagtgggttcttggttcttcttttttttaatttaagaaaattaactgaagcttgtttgatagtaattctcatgcacgactaggccattttttaattgtttctgtttttaagaaatttcaagatttttagtttattttttatctaaatagtcccctggattgttaaaaacaaaatagccttagtgctgcctggtgcaaaaactagatgtaaaggtattactggaaaggaaa

SEQ ID NO: 204849 - DNA, 601 bp, Human
gtagacaatacaatgtgtgcattgtgagaaatcattgtggattttatctttttttttgagaggagtgggcagtcttcctggttagtctttgctgtagaagaaatataaacaaaccatcgatgtttgttcacatctgttaataagcctgggatcttatcagagtctgtagagtttagtctggctgttggtaatgctggggagttgaaatgtccctttgagcatcagactctcggggagtacttaatagatgttgagtccagcttttcatttcttatcctagaggaagaaggcaaaataatcyatgactgtgaatggttgagatggctttttctattgccttatttgtttttgtagtgagagctgcttttattaagtagaatggttgctagcacatagaacctttggtcactgaatcacactctgaattcaataatttatttattcaacaaacacttactgggtacctaccataggcactttaagaaagggctgtgggaattcagagatgatgactgagttctgacccatctctggcccatcacatgggctagaaagaagcttaatctccgggtgtggtggcacgtgcctgtaatcccagcta

SEQ ID NO: 204850 - DNA, 601 bp, Human
aaagaagcttaatctgttttaggagataagacatgggtattaataactatgattatgtgacagaaagtgatagaacatgagaaagggcataagaaagtggcaactggagtgacatggaagttcagaaacatttttacttctatttgagggtggaggggaggttttattgaagtcaaggcgtttgagctgaatcttgaagattagaaattagacttattggcagaaattcttggttataaaattctaggtagatagatgatgacttttaggagactaacactatatgtctttcactgtcttrtccctggctccatgtgcaggtatactgatggaaggtatggcatggagatataatatcacatgccttagtgctttagcttaggtggttccttccacctcagtggtgatctgctctattaatctagggcctattcaacattcagagctaattttaaatgccactttctctagtactttaacaattctgtcattttttagttctgtatttattgatctcccctactagagctgtaccactacaatatgataacgttttgcacattctagatattcaactgatatgattcagttgaacaaagta

SEQ ID NO: 204851 - DNA, 601 bp, Human
ttctcaagcccttttatatgtgtttattagttaagtttgcagctctataaatgatatcatttgtactagttgcattggatccctgccatttctccatccataacagatggattctgttcttccattccactatacgttgctcagggtttgttactttctgatagacaacagaaatgagaatgcagaaatgggatggaaaagagggagtgagtctgttttattttgtttccatatttctcctaagcttactggagtggcaaatggtaggataagtggtcagctatactgccccatgagattyaaggagcctttggggaggaaggaaccttgctcagaagataggctggggaggatggttaattttggagattttgttgttgcttcatgttttcttttgatttccctcatctttgatgctgactctgatgttggctttccctatataatatttggacgagaacaaattttgcctactctctggcctgtgcaagtgacacgtacagagccattgtctgacttgtgacttggcccagaaagggctgattgtcatgcagttgggagggcttttagactgggtaaaaaattctcccatttgtttaaa

SEQ ID NO: 204852 - DNA, 601 bp, Human
ttattagttaagtttgcagctctataaatgatatcatttgtactagttgcattggatccctgccatttctccatccataacagatggattctgttcttccattccactatacgttgctcagggtttgttactttctgatagacaacagaaatgagaatgcagaaatgggatggaaaagagggagtgagtctgttttattttgtttccatatttctcctaagcttactggagtggcaaatggtaggataagtggtcagctatactgccccatgagatttaaggagcctttggggaggaaggaaccttgctcagaagataggctggggaggatggttaattttggagattttgttgttgcttcatgttttcttttgatttccctcatctttgatgctgactctgatgttggctttccctatataatatttggacgagaacaaattttgcctactctctggcctgtgcaagtgacacgtacagagccattgtctgacttgtgacttggcccagaaagggctgattgtcatgcagttgggagggcttttagactgggtaaaaaattctcccatttgtttaaaataacatgactaagattgaactc

SEQ ID NO: 204853 - DNA, 601 bp, Human
ttgcattggatccctgccatttctccatccataacagatggattctgttcttccattccactatacgttgctcagggtttgttactttctgatagacaacagaaatgagaatgcagaaatgggatggaaaagagggagtgagtctgttttattttgtttccatatttctcctaagcttactggagtggcaaatggtaggataagtggtcagctatactgccccatgagatttaaggagcctttggggaggaaggaaccttgctcagaagataggctggggaggatggttaattttggagattttgttgttgcttcatgttttcttttgatttccctcatctttgatgctgactctgatgttggctttccctatataatatttggacgagaacaaattttgcctactctctggcctgtgcaagtgacacgtacagagccattgtctgacttgtgacttggcccagaaagggctgattgtcatgcagttgggagggcttttagactgggtaaaaaattctcccatttgtttaaaataacatgactaagattgaactcagaagacactgtgcatgcatttcttttcaaattagtgttaagaaat

SEQ ID NO: 204854 - DNA, 601 bp, Human
aaagagggagtgagtctgttttattttgtttccatatttctcctaagcttactggagtggcaaatggtaggataagtggtcagctatactgccccatgagatttaaggagcctttggggaggaaggaaccttgctcagaagataggctggggaggatggttaattttggagattttgttgttgcttcatgttttcttttgatttccctcatctttgatgctgactctgatgttggctttccctatataatatttggacgagaacaaattttgcctactctctggcctgtgcaagtgacacrtacagagccattgtctgacttgtgacttggcccagaaagggctgattgtcatgcagttgggagggcttttagactgggtaaaaaattctcccatttgtttaaaataacatgactaagattgaactcagaagacactgtgcatgcatttcttttcaaattagtgttaagaaataaaagtttatactgcgacctggtatataaaattatagaccagtctagggctccattttgaaatattagaaaataatacatctttgtataagaatacctctaatagtatttagacatttttcccttcta

SEQ ID NO: 204855 - DNA, 601 bp, Human
ttcagcatctgctctgcccaactgccttccacccacacacctgtggctgagctccagcgatgccaaattgcttcactctatactttctcatctcggtgtctttgcacctgctgttccttctggttggaatgttatcttcttctgcatttgcttgactaaattctactcattctttaagtctactcaaacgctgtctcctctgggagcccttcctgactgctcttgaaagtcaagtatttaatctttggctcctctttggtttccttttcatactttaattatattatttatcacactgctrtaattatttgtttttatgatgcctccagtataccgtgagcaccctagtttagcatagttcatgaaacataataatgcttaggatattttaattgataagtgaagattacatttgcatagtggttttacctgtgtaggacattttcacctcttattacattttgtcctgacgacatccctgtgttgtagatactttgtttttttctgacagatgaggaagttgagtcataggaggaaattgaatcatagagatgatagatatttgcctacagcctcacaactaacttagtagcagagctag

SEQ ID NO: 204856 - DNA, 601 bp, Human
ggctggattattcctctctgtacacataggtatgcatataatagagataatataaatttataaccacatatatgtacgtatatgtggaaaagggaatatatttcatatggaccaaagaaaaacattttgccaaactgtcattattgattaaataattcagcatgaagccagcaggcagatatccacaaaacttaacactacacttgcttttgaaaaacaaaaaaaggttttaaatgtaatcgctcgaaggatgttttttaatattaacccacaccaacctgcttcctttggcttgagaatratacactttaaaaaaatctgttgtgccttgaaaagaagagtaaaacttgctatcttctaactccatttaacactacatttgattcctttttatataacgataacttgatcctactcaaaatacttggcacctttagtgacagagtggcatgtaagaacactttaacagatttgaatgtgagtaaactccagtagttctgaaatgaagaggtagagttttcagttccttattcagagttcacagaagataagaatactgggattaacacaatagactccccttcattacacctggctgaat

SEQ ID NO: 204857 - DNA, 601 bp, Human
ttaaaaaaatctgttgtgccttgaaaagaagagtaaaacttgctatcttctaactccatttaacactacatttgattcctttttatataacgataacttgatcctactcaaaatacttggcacctttagtgacagagtggcatgtaagaacactttaacagatttgaatgtgagtaaactccagtagttctgaaatgaagaggtagagttttcagttccttattcagagttcacagaagataagaatactgggattaacacaatagactccccttcattacacctggctgaataaagcaaytatctgtctatcaagactagcaacttgtgcaacagcattaagaaagagtggatggataggtggataaacgctattccattggaaagcggtgctgatatatgaggtaatcctttgagtttaacttgtaaaaacagttttattttggagtttatatcatgttactcttgcagcttagagagaaatgatttttcaaaatattgttgactgcatttttcagttctttacccatctgaattttattaggggggttatttcaaagacgtctcttgtttaatcatgtttaaacaatctgtttaagac

SEQ ID NO: 204858 - DNA, 601 bp, Human
catttgattcctttttatataacgataacttgatcctactcaaaatacttggcacctttagtgacagagtggcatgtaagaacactttaacagatttgaatgtgagtaaactccagtagttctgaaatgaagaggtagagttttcagttccttattcagagttcacagaagataagaatactgggattaacacaatagactccccttcattacacctggctgaataaagcaattatctgtctatcaagactagcaacttgtgcaacagcattaagaaagagtggatggataggtggataawcgctattccattggaaagcggtgctgatatatgaggtaatcctttgagtttaacttgtaaaaacagttttattttggagtttatatcatgttactcttgcagcttagagagaaatgatttttcaaaatattgttgactgcatttttcagttctttacccatctgaattttattaggggggttatttcaaagacgtctcttgtttaatcatgtttaaacaatctgtttaagacctgttgtgtagatataaacacaatagtcctttaatgtcgtaaaacagacttctgacagacatagcacg

SEQ ID NO: 204859 - DNA, 601 bp, Human
catgatgctttcatccaatctttttaaaaaattttttaatccttttttgcttcctacctcctatgaagtttctttttcttcagacgtctcaagtttttttagtccattatctgaagaaaagggattatactgtaagcacgtgtttattataatttatttcctgaagtttgactgatattggcgtagcctgataactgtcctttctcccagacactgtatgctttgattgttgtgattcgccacagcctaaaacctaaaagttataaaggaacttgcatttatagacattcaaattaacatygtacaattcttttatttatttatgaatttattcaaagatctcgaattcttcaatccttagaagcctaaattttgaaaggagcaggccttcacttctctctcacacacatctaattgtatttaaatatgactacatatgagattgagatagtgaactttatgtcactggtctaaatgggtgccttttagtattaaaagaaatcaaactcagcttttaacattttttctatgaaatggagtccctagaatatttctatggagtctatggtttaaccatgtaattatgtctcttgagtagatt

SEQ ID NO: 204860 - DNA, 601 bp, Human
caagtggaggggacagcttgagcaaaggcacagggtgtatttggactgtcgatagaccagtgtgagtagagcacaagctgggagcagtacagttgtagccattggaaatgagagtgacaacgcatattgcgaccatattttccaggtccttatttgctgggctcagggggctctatttaattcaatagacaatggaagacaattgaaaggttttgagcaggtaagtgacatgaatgttaggatttgggggcagaaagaatttcagaaattatggaaactaactcttcattttttggtagaygaggaagctaagaccaacagggttccattttggtgcccttccaaatatgccaggctgctactctgttgtattagccacaggccagaggttaggagggttctagtggaggcccattcctgaagaaactgtagaaatgggctggagtggatgatgggggtctaggaaaggaggtgacaaagatatgcctaagctggattttgagtctgagagactagaaaatgatgatgatgaaaataaggaaatcagaagagaagctggttgggatggtttgaggaggaagggaggggcaaagggcttaat

SEQ ID NO: 204861 - DNA, 601 bp, Human
atttaattcaatagacaatggaagacaattgaaaggttttgagcaggtaagtgacatgaatgttaggatttgggggcagaaagaatttcagaaattatggaaactaactcttcattttttggtagatgaggaagctaagaccaacagggttccattttggtgcccttccaaatatgccaggctgctactctgttgtattagccacaggccagaggttaggagggttctagtggaggcccattcctgaagaaactgtagaaatgggctggagtggatgatgggggtctaggaaaggaggtgmcaaagatatgcctaagctggattttgagtctgagagactagaaaatgatgatgatgaaaataaggaaatcagaagagaagctggttgggatggtttgaggaggaagggaggggcaaagggcttaattaaacattacaagagtataggtctttgattcctagacattcacaaaccaccagtgaaatgtagtcatctgaacgtaaacagaggagcagactttcacttttctccgtagtatcttcatttttacatgtatgtaggaatgcagaaaatcaaagtttttaaatttagagcctcaat

SEQ ID NO: 204862 - DNA, 601 bp, Human
tttcataaaaatgggcaaaatgggtcacatcacacagagtcaagtttactttcatagttcacagaccacattttcagagtcttcgtgtgccagtttcagatgtgtgatttttgaaagcagaagttataatggtagtattactaactttcattgtgggtagggcacaatggggtgattcgctagactatggcttagggacttaactgtttctcatttgtctttgctctaaggatgtgtgaatgctgtgaccttttgattatgctttcttcttgtgcccctgaatttattgcaacaaaagtcrtattcagctaaacacactcaactttttgaaagaaatcttttctggaaaccacttttttgtttttaattttaaattgatttttgatcatgatttcccctgaatgactgctgctgaactattatgagctgaaataagctggttggcaatgggagagaaaacagccccaggccagcaatcaggaaaactgagtctggtcctgccactaactatatgactttaggtaaggcatgtcccctctcagggactcagggtcctcatccataaaagaagcatgttactctaaactttagagtctaaatg

SEQ ID NO: 204863 - DNA, 601 bp, Human
tgggcagtggttctcaatcctggctgcagattggatcatgtggtgaaatcttgaataaaagagaccttttccccaggtcccactatcagaaattctgatttaattgatctgatatggggcctggacatccatgtttcaaagctccctagggaattttcttattcagcaatgatggaaggattcagggagaaagttcagctagagaagggatccaggactgagcatttttacatagagtctcaagtataatacaggaattttccattcttcataccctcctcctgtttggaacatctactckttggcccgttggatgaggtttagtcctcactgcactatgacagagtaccctatccttgacttagtcagtgtgtccttggtcttccatgttcttaatttctgaaggaattgcttgggtgctggggatttaagtacaccttctttcagcccatcattcgagtgttaccctgatgtggtttagtggtaacaggtatttgtcatagttgaaatgtgaagaacttgtttggcttttgctcttcaatgtactttgttcttcaatgtacttcatacattatgaagagtgcattttgttgtggttgca

SEQ ID NO: 204864 - DNA, 601 bp, Human
tgctggggatttaagtacaccttctttcagcccatcattcgagtgttaccctgatgtggtttagtggtaacaggtatttgtcatagttgaaatgtgaagaacttgtttggcttttgctcttcaatgtactttgttcttcaatgtacttcatacattatgaagagtgcattttgttgtggttgcagtggtgtctgtgaaggggcagatatctacaaagaaaaatgcgtatgtttttgtatgtgtgcatctgcagataaatgtttcctgaattattctagggtgcctgtagatacttggaagygttctttgaagataatttccaaaagatcatgaagggttttaaaatttcacctgctttaaaatttttcacacttaccagtcctagcctaagtcctttatttttgcctgcaaactcttattactcctgaaaacgctgggctaagagaaagtaaaaatgtactcacacatgtacagtctgagctcacatctcatacagcctctaggaaaacctaatgaaaaggctatagaaagcagaggcaaagcttattaaattttcttgtgacccatggcccacgtaaagtcctagtgtataaaggaacca

SEQ ID NO: 204865 - DNA, 601 bp, Human
ctcactggcacagaatctggaggaaggaatccccagtccatttctgtttctctattagcattgcatttgtccccaatagcaccaccctatagatttactctactgtggtacacccagattcagatgcttttctgttatacttgcaccaagacactagtatgtcttttgttaagaatgatttgatgatttttaagaagtcttagtatcttggtttgttttaatttgtgcatttctctaatacccagaatttctttagcttttagacttgaataaactagaagagagatagaaaggctccccycctccgccaaataatggattgtcacagtcacatgtttacttaaagagtgtatttcagcttcttttccaaaaccacagtagtggatttaaaataaaaaagcattctctctgatttaacagagtttattatacacattccagctttggcatatcacaaaatatccagattcctcttgagaatttgagtttccctgcttacatttctgtttttttatttcttaaaggggtttaggtttgagttttaattttccagaaaagagtcttagtaaagagtagttgtaacgttaaagaaaagtcacta

SEQ ID NO: 204866 - DNA, 601 bp, Human
tattttaaaaaataatatagaattataaaaatcaaacatctaaacactaaagataaccagatatctgcattaaggaagaacattattgctctttgaagaatggccatgttttagactatataaaactttaatcattcatatgtggggttgaaaggtcaatgtgttcactagacatatgtccttgataaaaatacaagagtaaaattcacactaacttgtgaatttgaagcttgtagctatgggtgctgctgcatttaaagtagtggacttagagactacaaaagatgggagagtggggggrcggtggtgagggttgaaaaatgacccttgagtacaatgattgctgtttgggttatgggtgcactaaaagcccagacttcacctctatgcactatatgcatataagaaatccatacttataccccctaaatatatgtaaaaaaaaaagtagtagactttagattattcattaaggcataaaatagctttccttttgtctttatagtaatccttagactgtgtgtgtgtgtgtgtgtgtgtgtgtgtttgtagaagcaaatgtatatatatacacacatatatatgtgtttatatatgattt

SEQ ID NO: 204867 - DNA, 601 bp, Human
ttttaaaaaataatatagaattataaaaatcaaacatctaaacactaaagataaccagatatctgcattaaggaagaacattattgctctttgaagaatggccatgttttagactatataaaactttaatcattcatatgtggggttgaaaggtcaatgtgttcactagacatatgtccttgataaaaatacaagagtaaaattcacactaacttgtgaatttgaagcttgtagctatgggtgctgctgcatttaaagtagtggacttagagactacaaaagatgggagagtgggggggcrgtggtgagggttgaaaaatgacccttgagtacaatgattgctgtttgggttatgggtgcactaaaagcccagacttcacctctatgcactatatgcatataagaaatccatacttataccccctaaatatatgtaaaaaaaaaagtagtagactttagattattcattaaggcataaaatagctttccttttgtctttatagtaatccttagactgtgtgtgtgtgtgtgtgtgtgtgtgtgtttgtagaagcaaatgtatatatatacacacatatatatgtgtttatatatgatttgt

SEQ ID NO: 204868 - DNA, 601 bp, Human
tcctccatcagactttggacttttcaaagtctagggccatgttttcttcatctttgtgtcccccattgtcttacacggtacctgcttactacgtgacttttggttcggtgatcagtgaataaatggggtcactgacctcttcaggaggcgggacccactattatcctagccttaatatttttctagtgtctgtttgattgaattactattagttaccatttattaaatgcttgtcatgtgtcaggcattgttctaattagtttaactcatacgttcctcacaatagctctatgagataggwggcattcttatggaaactgatggtagacaggtggaataactcacccaaggtcccacttactactagtaagtggtaaatacaggaagtaaaggcagctctccatagctccatggccctgtgtacttaccaccaagtactcttgggaagctgaaaggtacttttatcatggctcagcttcctcccatttctgtacctcactttcatttattcagttctttaccatttacaaaccaaaggcctaaaacaattctaaaggtacatatttcacagatggaagaaattgattcttggagaaatgac

SEQ ID NO: 204869 - DNA, 601 bp, Human
ctcctatataatgcctcattttatccttcttcccccaaaacagttccatttctagcctgtctttaactctccatgcagaggaagtcttgattttgttctcctattcttttccaacacatcatctttctcttttagttttatatttagttttagttttatatacatatgtatatgtacgtatatatgtacacccacgtgtatgcatacctgtcccctttattagttgcttagggtccttttttgccctgttttaccttttgtgatggactgtgggcaaaaggatcagaataggagattaatgttgaaggaaatattaacttatggggtaacccagcagaggggcaagttaggcctgcgctttgtgcaaagatgccctggtggtatattttcacactaaataatggatatgcttcacatatccattatttatgtgatatgcttccacatatctcagggcttcacacagagagttggtgtacattgactgtgcagtattaatagcaacaataatatattatagatatgatcagtctaaaaagtgttttcattttaatgtatgcgaaagtattccaggaatataactgtatggcactactcccag

SEQ ID NO: 204870 - DNA, 601 bp, Human
ccacaatctatatattaatgaccactttctggcaggctttttaactagctataaatcacttagagataaggcatatatcttgctgaggtccagatatgcaatagacagatgagctgccttctaatctattgctttagtaattctaggagacagttttttagtgagcccattctgctttctgatagtcactgtgggatgaagtgtgagaagttctttgcacactggctattgaaagtgtttttagtgggctgcaagcaagtcaacaccaacagtggctccaaaacaacttagtttcagcaamttagattttaccaatagcaatgctgttttcagaataagataaatggaataagggaatgtaaaacctagtgtattttgtgtcgtaaactttaaaggcattatcttcaagtaatttaacagctgtcatgtggagtagtaatcccagagagcaaaactaagattagtagtgattggagttatagggaggcatattttacttaatctaaggaaaaactttttagaccctgctccatcaagaagcagccccttgagtactagttacctacatttttgccatgttgtgggatgtcatttatcttgg

SEQ ID NO: 204871 - DNA, 601 bp, Human
tgatgtgtagggataatttgaaacctattccaagtgtattaactccagttcagatatgtttgaaacatggaacttaccctatgtcacccagagttttttttttaatatatatatgtatataaaataattaatgcctattaagtctattttgtgctagttttctcttaatcgttttctcctgtaattttcatatccttatgattcaggtattattgctgcccctccttcctcaccttttacagatgaggaaactgaggctcagagtgactgagtaattaagccaaggttacacagaaagaagaagtctcagaacttggacctaattctgaacattccaaagtccgtgcatattctaagataccaagctatcttgtgaacagcctggtctattagaattttaaaaattaacataatttaaaaattagcataaaaacgtgttaagagaaatttggttatgattttgtttgattagccctcaagtaagagcaaaagagtttgaaatacatactttttttgctttggaaacatacagcacatttacctttttttctgtatataagcagaaggtcttttaataaatctatgtggccttgagtttgta

SEQ ID NO: 204872 - DNA, 601 bp, Human
tatttacagagcaaaaagcaattgggaaccattcacaaaaaagtcaataaagcattaagagaaaataacgattcaattatgtcagacaatagaaagtgctgagttacacttaaattaactaggcatgctaatgctgtgttccaagggatcataggaatagaaacaaccagaaagatccaccagaaagaactgttccaaaagaaattccattttctcctaaaagaccattccaaagaaagaccatgatttaatctacctaaagaccttcagagaatccaatatttcacctttctttattagyatcctttcttctgagtaattttcaagcatggcaacaattctagaagttaataaatgacaataatcacagtgatattatattagatagtcttgtagttttcctcagaccatttttggaaggaaggtataaacaaaataagataaaatgataaaggtatgttacctacaatccttactttactgcagagaaagatataatactagacgtcttcaagttcagaggtacaatacaatgattcaggaaatatttccttaacattgggtagccttaaatattgtaatggaacaacaagagcacata

SEQ ID NO: 204873 - DNA, 601 bp, Human
cagaaagttaaagcaaccataataaaacactagagcatctactttttactacagaaccattcctttcttaagagccacctgtttggtagacatactctgccacagcagccacaggcaaataattaagtttaataggagtaactcttattttgaagaagttctccgtttaaagccacagagtggggaagttattaaattttatggaccctaaacaaaggcaagccctgtgtcaaaaattgaatgttccgtattcttcattatatcgccactgattggatggattacttttgcattccataarttgaaattcatcttgctttccctaaaaatagcctatcttttgacatagcagatggtgttctaatcttacctggacctccgtttactctaatttttgatttactgctgctgaggcccaaagaagtggttttcattcctactagatcagttggagataatagttggtccagctcacaaagtttactaagcttggttgtatgattaattactgttatttgtagctacactgagatactaaagctcagaatgaaacctgtgtacatggtttgactctgattttatacatggtttttctcagttg

SEQ ID NO: 204874 - DNA, 601 bp, Human
atctctctttcccttctcttttcctgagcccctggcaaccacagattctttttttttaactgtctctatagttttgccttttccagtgttatatagttggaatcatacaataagtaagtagcttttgcagactggcttctttcacttggtaatatgcatttaagttcctccatgtcttttcatggcttattaatgcatttcattctaccccgaattgcattccattggaaggatgctattatatatatatatatatgtgtgtgtgtgtgtgtgtgtgtgtgtgtgtgtgtgtgtgtgtgtrtatatatttgagatggagttcgctcttgttgcccctgctggagtgcaatggcatgatctcggctcatggcaacctctgcctcccagattcaagcaattctcttgcctcaccctcccgattacagactgggattacaggcacccaccaccacatctggctatttttttgtatttttagtagtgatggggttccaccatgttggccagagtggtctcgaactcctgacctcaggtgatccacctgccttggcctcccaaagtgctgggattacaggtgtgagccactgcacccgaccggatg

SEQ ID NO: 204875 - DNA, 601 bp, Human
tgtttaatgaaacaagtattagtgggaaagaagattttaaaaaaaagaggaagatagatatgtaggagaaaaaaaggaagaaaaaagattttgttcacctggaacaacaaagaaagggcaaaacaagagaaactttcattgctgataaggacaggaaatagcacagtaagagtgtgcataagcagtatatatttttatctccaagtctttttgcaatatgtttcatatttagaacacatatcaagactgtatctgtttccagaacttgctgctaacagttagtaacaatgccaaaacatawtttaggtccagcttgaaaccaaatgatcaaatagaatttttgatttccactttagagtctgacattaattatagccatcatgtaataaagtgtcaaagctcttttctgagaaaatgatagaaattatgttaactaatctgtaaactgaagcacagctattcctctacaacaaagcaaaagatagggttttgacagctatcatttctcatagtcttatctttttcaggctgaatttttcctgtatgccccacctctgcctgttttttttgacgctttctgtatagtatggttgcaggtcat

SEQ ID NO: 204876 - DNA, 601 bp, Human
gtttccagaacttgctgctaacagttagtaacaatgccaaaacatattttaggtccagcttgaaaccaaatgatcaaatagaatttttgatttccactttagagtctgacattaattatagccatcatgtaataaagtgtcaaagctcttttctgagaaaatgatagaaattatgttaactaatctgtaaactgaagcacagctattcctctacaacaaagcaaaagatagggttttgacagctatcatttctcatagtcttatctttttcaggctgaatttttcctgtatgccccacctytgcctgttttttttgacgctttctgtatagtatggttgcaggtcatcctactggtctggtcagtggtctctgacacagttcattagtgtccatcttaacgcctcgtacccagaaccaaactattcctctcttctcaggctctggtagtgcaggctttagtggcctttgttcttttggtgaccatattacactgttttctcttatttgccacttctgtcaatctgcatttctccaattatttacttttagagctgtttttttgtagatccaaatatgatactttacagttatccctgttag

SEQ ID NO: 204877 - DNA, 601 bp, Human
atttcaagtcagctcaacaaatatttggcatgtacttaaaatgtgcttatgcaggtgagaagtaaaaaaagaaatagaagatatagtctctgccttcaagaagctttcagtctcatttaggatacaacataaagcaaatgtgatggttacattatagtactagcccatgtagatgccaaaaacatgcaaagaatgctcaggattttaggaaaggagatctcttttgttcctttgctctattataataattcacatccgtaaccaacttaaagccatctgcattaggaaattaaaaaaaaamaacaatcccattcagctcagattatactttcactccgaattgcttcaacaattacgttttcaacttttaaaaattacgtatgtttgatgtgtgtggcttcatgtttcttaagatgtgacaaggatatggaggatcttgtcttttcccagctagactgaaagctcccctaagtcaggggcctagtcttctaatcctttgctatctctccagagctcctgctagattgaagactcccattggcccagggcctggccttctaatccctttctatctctaactcctactccgatgctcagcatg

SEQ ID NO: 204878 - DNA, 601 bp, Human
taaaatgtgcttatgcaggtgagaagtaaaaaaagaaatagaagatatagtctctgccttcaagaagctttcagtctcatttaggatacaacataaagcaaatgtgatggttacattatagtactagcccatgtagatgccaaaaacatgcaaagaatgctcaggattttaggaaaggagatctcttttgttcctttgctctattataataattcacatccgtaaccaacttaaagccatctgcattaggaaattaaaaaaaaacaacaatcccattcagctcagattatactttcactcygaattgcttcaacaattacgttttcaacttttaaaaattacgtatgtttgatgtgtgtggcttcatgtttcttaagatgtgacaaggatatggaggatcttgtcttttcccagctagactgaaagctcccctaagtcaggggcctagtcttctaatcctttgctatctctccagagctcctgctagattgaagactcccattggcccagggcctggccttctaatccctttctatctctaactcctactccgatgctcagcatgcataatgtcgtgggaagtactagcattcagtagaaa

SEQ ID NO: 204879 - DNA, 601 bp, Human
tctcatttaggatacaacataaagcaaatgtgatggttacattatagtactagcccatgtagatgccaaaaacatgcaaagaatgctcaggattttaggaaaggagatctcttttgttcctttgctctattataataattcacatccgtaaccaacttaaagccatctgcattaggaaattaaaaaaaaacaacaatcccattcagctcagattatactttcactccgaattgcttcaacaattacgttttcaacttttaaaaattacgtatgtttgatgtgtgtggcttcatgtttcttragatgtgacaaggatatggaggatcttgtcttttcccagctagactgaaagctcccctaagtcaggggcctagtcttctaatcctttgctatctctccagagctcctgctagattgaagactcccattggcccagggcctggccttctaatccctttctatctctaactcctactccgatgctcagcatgcataatgtcgtgggaagtactagcattcagtagaaaagtctacccaggaatcagtgctgcatgcttcagggttcttatgctgtgactattattagaaattggctaataga

SEQ ID NO: 204880 - DNA, 601 bp, Human
aaaacaaacttgtaagctcccaaactacaccttaggaaaacagtacattctcagtgtggcttaaagatatggtagaggctgggcgcggtggctcatgcttgtaattccagcactttgagaggccgaggtgggtggatcacaaggtcaagagattgagaccattctggccaaaatggtgaaacctcgtatctactataaatacaacaattagctgggtgtggtggcgcacgcctgtagtcccagctacttgggaggctgaggcaggagaattgcttgaacccgggaggtggaggttgcagtragccaagattgcgtaattgcactccagcctgggtgacagagtgagactcagtctcaaaagatatagtagagaactgacctaaaagattccaaaaaggaaagagtttggccctcagagcagttaacaaagaaagttaaagttgttctctaaccttagaaattggcaggtgccacagatactctttgaagggttaataaaacctcacataacctctttaatccagtaggtggttgaaacttttgaattgggtcttgcctcccaaagaagaattgagttcaacactgataaaacagcagttgc

SEQ ID NO: 204881 - DNA, 601 bp, Human
aaggcctgaaagggcaggttttcttacaggagagatttagtaatcatcacatcagaaaactaaattccggctgggtgcggtggctcacatttgtaatcctagcactttgggaggctgaggcgggcagtttgcttgagcccagcagttggagaccagcctcagcaacatggcgaaaccccgtctctacagaaaatacaaaaattagctgggggtggtgcgtgcctgtagtcccagctacttgggagactgaggtgggaggattgcttgagccagggaggctgaggctgcagttaactgagaytgtgccactgcaccccagcctgggtgacagagactctgtctccaaaaaaaaaaaagaaaactaaataccaccatcaataataacactaaaggctaatatagcatttaatcgaagaactaaattaacaggagcaactatgatagatgtcaggaaaggttttgttttgtatttcagttaagagattctgatgagaagcaacctaagatcaggttatttaataccaaaaaactgtacatttagatcttgatacctgaccacagctgaacctgtctttaaggtgaagccttatatatgtgcatg

SEQ ID NO: 204882 - DNA, 601 bp, Human
aagattagcctggccaacacagtgaaacaccgtctctactaaaaatacaaaaattagtcgggtgtggtggcacgcaattgtaatcccagctactggggaggctgaggcaggagaattgtgtgaatccaggaggcagaggttgcagtgagcctagcttgtgccactgcactccagcctgggtgacagagggagactctgtctcaaaaaaaaaaaagatgcacttcaatggaaagcatcatgcatgcaggtgtgaccaggctggctttgcaggcaatcattagatgatcacactgggcagtgygtggcaacagctctgaagtgaagaaacacttaggcaaggggctatcagttccttcaggctggcgagctaatatccagcagtcaagaaaagtcagtccaggtgagaaaccagcacttgtcctccctgtggagtcagtacccaaacagcttcttcagaggactgagaaattggggcttatcttaaatagcaaggaacttgaattgataagggatgaggaacatgttctaagcagaatctcataaccacaagccaagcttataggagaaagctttaaacaggtaaccctgttggcatcacagt

SEQ ID NO: 204883 - DNA, 601 bp, Human
cactttcatagacattatttcatttaatcattacaacgcattgaagtatcaatactactatactcagtagtttgccagcaggaaatgagggctcagagacatttagagatttgttcagggtcatcaagtgaaagggatagagagtgaaaactcaattccaggtcttttagctccacataatatgcttttccctactctgcgttgctgtaggagtctccatatcagaatcggactttgctacaaaggcctgttggctatcatcctaagaggaatatttgttatcactgatctttccagcccaaacctggataacaccattaatccttactaagtagccaaaattcatggtttgatgcagatcagagaacccaaaataaagtaaaatggaccaaatccctaacaagaaataatagtggaaaaatctacctcccaattttgtaaacataaattttattctagaaattaaaaatgtacacattaatgaaatcttaaaacctcaaaataggccaggcacggtggctcacacctgtaatcccagcactttgggaggccgaggtgggcagatcacaaggtcaagagatcgagaccatcctggccaaca

SEQ ID NO: 204884 - DNA, 601 bp, Human
cattgtgacctgaagaagaagaaaaaaaatgaaccaccaatgacctcttcctcctctgcacctttcctcttttcacccgaaaattaagtccttatgaaaagattaaatagatgtggccctgcatctgtggcagcactgtctctcctgaccagtcactgactgttttggtccacatctggagtggactcagtggacatgattctcaggctgagaaaaataggacttggattttgtccttggcaggcagagaacttccactgtttgaggagctactactggactactgtgtgtttgtcccacrtcccacagctagctaagcagaccgggctcttttttttttttttttttttcacggtcatcaaaacaagtagctcctctcagacaccttaatacataattaggtgtgtctgtttacacttgggagacagagggcttcatgtcccagagaaatacaagacgtctgggaacagccacaaacagatgttgaaaatgtccatttgtggcgagtttattactatagcaccaggaataaacattgaagatgaaacccctctgaaggggtgtgtgtgtgtgtgtgtgtgtgttgagaggggaatgttat

SEQ ID NO: 204885 - DNA, 601 bp, Human
aagggacgtttttcttgcagaagttttgagttaattctgtgtgcagggcttgagtggaaaaacgctgagactgtcagaggaacgagttactacaacactacatttggattcggaagttacataaggagcattgtctcaggatagcaggaagactcttgtacatggttttaggctaaatcctaacaacaaagagaaagaaattctttgcaaagtcagtttttcagttaaataaaaggtagtagtttggttcctgatgtcactggatataaacatccagtgcgagaaggcataccagtcatcrctttaaaaatatcaattgaaatgtgccctgtgccctgtttttaaagaaataccgtcctttcccctgttgagactttttttttttttttttttttttggagacagagtctcgctctgtcatccaggctggagtgcagtggctcgatctcggctcactgcaacctccgcctcctgggttcaagtgattctcatgcctcagcctcccgagtagctgggactacaggtgcccgccatcacgcctggctaatttttgtatttttagtagagatggggtttcaccatattggtcaggctggtctca

SEQ ID NO: 204886 - DNA, 601 bp, Human
aggatagcaggaagactcttgtacatggttttaggctaaatcctaacaacaaagagaaagaaattctttgcaaagtcagtttttcagttaaataaaaggtagtagtttggttcctgatgtcactggatataaacatccagtgcgagaaggcataccagtcatcactttaaaaatatcaattgaaatgtgccctgtgccctgtttttaaagaaataccgtcctttcccctgttgagactttttttttttttttttttttttggagacagagtctcgctctgtcatccaggctggagtgcagkggctcgatctcggctcactgcaacctccgcctcctgggttcaagtgattctcatgcctcagcctcccgagtagctgggactacaggtgcccgccatcacgcctggctaatttttgtatttttagtagagatggggtttcaccatattggtcaggctggtctcaaactcctggcctcaagtgatctgcctgcctgggcctcccaaagtgctgggattacagacctgagccaccacgcccagacctcccgttgagacttctgtttggatggaaagtagtagatgctaatgaggcacctctat

SEQ ID NO: 204887 - DNA, 601 bp, Human
aggtagtagtttggttcctgatgtcactggatataaacatccagtgcgagaaggcataccagtcatcactttaaaaatatcaattgaaatgtgccctgtgccctgtttttaaagaaataccgtcctttcccctgttgagactttttttttttttttttttttttggagacagagtctcgctctgtcatccaggctggagtgcagtggctcgatctcggctcactgcaacctccgcctcctgggttcaagtgattctcatgcctcagcctcccgagtagctgggactacaggtgcccgccaycacgcctggctaatttttgtatttttagtagagatggggtttcaccatattggtcaggctggtctcaaactcctggcctcaagtgatctgcctgcctgggcctcccaaagtgctgggattacagacctgagccaccacgcccagacctcccgttgagacttctgtttggatggaaagtagtagatgctaatgaggcacctctattgggggaaaaaaggacacaaattggaaacccaacgcgttcacttcagctctgcactaatgagctgtgtcctcgagatggtgccttctttctctgat

SEQ ID NO: 204888 - DNA, 601 bp, Human
ctgagctgtggcatcccagctgtttggttagccactctttcctcttagtcaatttttgctaacaccatgggatgctgtggctattccatcacttataggattcatatggttagggaaaagcgactgactagtctgttaagcaataggcagttctagttcccagcccatcatcaagcagcttcaagtcagaacattcctgcaccagggcttcaggcttgctaccaagcctgaaagaaacgctgcgcagatttttccacgggagcgcctcaaagggcagaggaaactcaagggctccttcacyatccctgctctccctgatctgctggcataacccaaaacaaccccaggtccccaaagagaatattttcaagtctcttgttttatctgagaatgtatgtgaattttattttagaatatgtatgtttttgttttaatatataaataacgttttaacttactaatatcagttaaatgtccccctttaaaaacccttctccatttgtccacttcttgtatttcatgccttcctatcagttaggctttggtgtctaatatataacatctcaaccagttcataaatttctgcttttaatatagacca

SEQ ID NO: 204889 - DNA, 601 bp, Human
tgccttcctatcagttaggctttggtgtctaatatataacatctcaaccagttcataaatttctgcttttaatatagaccaagttaccactagcgcaggccacaggaaaataccagtctgtcctgtctgaattctggcttttttgaaagatttacttaggaacaatttatcatttagtttgcaatttttaaaataatcttaattgaccacatatgttatcaaataagagttggtcttgtagcctctgcctcgctcgccatctccccgccacctcccaccccctcatttgcacatgtgtacraccttctgccaggatgtcagaaaattaattatgccactccaggcagataccatcgcaggaaaggctctctctgatttaagataagattaccaatatctaagctgttatttttaggagggaaaggctatcacttttaaacctctctccctcattttcctagttccttctctcctaatttggctccatgttttggtagccataagtcattagtggtttttaatttttctgaaactgaaataaggtctgaaagggtggatttgtcccttttttcctccttttttcctttttttttttggctgg

SEQ ID NO: 204890 - DNA, 601 bp, Human
ctttcttagccttaggatcagctagttctttcagaatttgtgagcatgcagtggaaaagtacaattcattacaacacagaaaacaaatatttagactggatagtcgagggactttccctctcttttgcaaaagaatggagtttgctggtcatttcattatcttaaaatgattttacaatctcattttgctggtttcttctccatcagcatgatccattgcatgtcttctatatatggtatattttcctaattattatctaatgaaatgaaaagtaaaactaagttagtgatggatagttgrtcattttttagtgtgaggggagaaattcagggaaatttagaaaattggtcccttagaacctcagtgtggaaaatgcaaagtaatattttgcatatagtctacatttgacttttgaataatgtttatccatagcatttctacctctgtcgtgtttgcctccttgagactttggtagtaattcatctgctttgcaaaattttttgaagcatctgtcttctcagcaccatactataaggtaggatctggaagaagaatatgtggttcttcctcttcatttgcttcctctttagttggaaaatg

SEQ ID NO: 204891 - DNA, 601 bp, Human
gcaaagcagaggcatccgtttactagtgtcaactgctgttttgggggctcctgtctgcaatgtgaggtcaagtgatgcaataatgcttgggaatagctttgaatgctctttaaagagagttgtataaggttttataggtatggaatgtatttgaattacattttaggtttgatgtcagcattgctcaatgcttttcatatcttttccttttgtgttaaaactgtacagagttattgtacagagttcccaatccttagactcatttacgtattcatttatccatccaaccatgcactgacattttttttttcattttagcctcttacaatgtactaggttccaagagggatatgagaggaaaacatattctttaccatccaaagctgactttatagttggagaaaacagactaagaaacagctaataattcaataagggagtgagtaagggtccaaaagagtgatatagaaaataaatgctattggaacggaagtaaaataggaaattaaataatagagctgttgggaagggggcagccaaaacgtttaaaagggggagaagattcttggttaccaggggagagcagctccacataggtctt

SEQ ID NO: 204892 - DNA, 601 bp, Human
ggcatggggtttcccagctgacagccccaatggcaagtacccggtctgttattttggtcaaattccaatttcttttttgttctagagatctccttacccattttccgtcaaccaaccatatttattgggggcctagtcaatgagaaaatgtatgttaaagtaaaggccttcaaatgtcaaacaggtgtgactgttatgaagttctgaaggggaggcaaagaagtatcagacacttctctaccctccacagctcactctcagtgggagccaaacgtgactcaggataagcagcattcgaaarcagtgtgtgaaagatgccacagggaggattcccggccctgaaaattgaagatcagacattctgtttgattccctcttatcttggtttcacacactttccacttgaagacccaagaaacctagttgggtaaagagaggctatttccttttccctcatagaccttgggaggaggggcaagatgttttaatttttattagtgattttatttttatttgtgctccatggaaatgttattaatatattctttcctgtgtatattaggttgtgaaaaattgctgctgccgctgctgttactatttt

SEQ ID NO: 204893 - DNA, 601 bp, Human
accaggcatatcactgggggagtggctgagctttggttttatatttagaaaatcagattggggttgcactgcttttagaactctaggccttcataatatggactcttaataagtcaaacttatattttgcttactttagttgatgtaacatccagttagttctatgttggtaagtttgtggctacaatgtggttggtgacacaaggatgactagtttaggatacaatgtcaaaatagcccaagcaggggttctaaaagaaaacctgagttcatgtacaaaacagacattggaagcacagayacaaccttattcaatgaaagaaaatttaaggatattatttgcttctgtaactattattatttaaaaatttgaagattaggaaggagtttatagtctttcttttaagtttaggatttctcccaccaccttatcatgattattttataagggatctcgtatggtactagagcaaattgttactatttcttcctagagaacatgttgcaaaatgtttcaggaacatttcttggtaacataaagtgactaagcaaattccagaaaattctattgtttgtaagttgaaaaatcatcctataatcc

SEQ ID NO: 204894 - DNA, 601 bp, Human
aagtttaggatttctcccaccaccttatcatgattattttataagggatctcgtatggtactagagcaaattgttactatttcttcctagagaacatgttgcaaaatgtttcaggaacatttcttggtaacataaagtgactaagcaaattccagaaaattctattgtttgtaagttgaaaaatcatcctataatccctttcaagtcaacattagcgctctttatcaagaaagagtccattctcaagacattaagactcaaatgcctagaagtgattggttaaaatactgtaaacctagcrgaaatttgttgcattgttttctataaaccataaccagagctcattaattgaaaaacaaatgtcattttgtgttagctagcatctataaaccaaaaaggtacagtgatcctggcatgtgatgggcaataaaaacatcagcaaaatgtatcaggtaaaattgagaggaaggagtggggaggggtaaattcaaaaccatattggagtttactgccagggccccacataaagagttttaatgaggcttctgcatcaaaataagtgaaaccatacggaattgtaattattactgcagtgtatttt

SEQ ID NO: 204895 - DNA, 601 bp, Human
tcaattctagaaaaataataataaacccaatctttaaaggtcacaactacaagattctagcatttcagaaaacaaatttccacatgaaatggtttataacggtggtttcataacttaggcaccagaaacatctattaaggaggcctactgttagctttagaagtgaaaggacttcatgttttaggggaaaaccatctttgccttcaggttactgcttcaagttgacctgaagctggttctgtaggatgtggtgctggggcctgggagacgggtggggagtgccctcctcttaatctccccyaggcagcgagcctctcgcaaaagctactgttagcacctggtctaaatcaggtcacaagtctcccatcaagacttgaaatcaatgattcctaaggtaccaagcccccttgtgcctcctaactcccattttcaaaaccgactgatctagtagcttatgaccctccctatccacccccagagaagttatgagtttctggtttgatttcactgttgctaagatgagacctctgacaagattttaaattctttaaaggccttaaaggaaatgataggaacatgataggatatctttttgatgttc

SEQ ID NO: 204896 - DNA, 601 bp, Human
ggtcctgacccggtgcctgcgccctccccacaggacaggcatgttgttgggactggcggccatggagctgaaggtgtgggtggatggcatccagcgtgtggtctgtggggtctcagagcagaccacctgccaggaagtggtcatcgcactagcccaagcaataggtgagtcctctcggggtcaggcaggccgggcaggtagagctgaagtgggacctggtggtccagctccatggtctcccccaaggagagtggggctggttgctgatcctttttgttcttcccaactcttcaagccaggyggacagagagtcggggggacataggctgaccttctcctcttcttcccaggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgc

SEQ ID NO: 204897 - DNA, 601 bp, Human
gccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagrgtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctg

SEQ ID NO: 204898 - DNA, 601 bp, Human
ctcaagattacagatttgcctaggccctatcctttaatgccataaggacacacctcttaccatctctacctagtgtccttggccctctcctctccccaccgggtgagaaaccttcttgggaacttggttgaaagctgtatttgtacagtaagtataccatttttagtgagactgtatattatatggagtggcagggaaggttgatggagtttatagggcaaggtggcaccattccacccccagccactatgaaagaatgagatcataagcttcttgggagtacgagccatatcttacatgyttttctgcatcaccaaatgagagagtagatgtttaagaaacacccacaaaatgtctcaggaagtcctcttccacatcttatctcctaaaacccatgcagtatgtattaaaaaaaaaactgtctccaacagaagggctcttcctcaaaacaagcaccaaagggctaacatcaccttaaaatggatacagtattttatagtgtacaaaatgcatttaaatgcatttcctcatttattcaaggtaagaattgcaggtattagtaccctttacagatggggacattgagcttctataaggttca

SEQ ID NO: 204899 - DNA, 601 bp, Human
ggcttcttgtcttgcagatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccaggtgagtgcggggctggggcaaggggagggggtrgggcctggggtggggctgtggcttcaactgcaggacgaccgcctcatcttgaggcctctgggaggtaggtgctgtggtctccccgcttgacgcagagtatacagagcctcggggagcagagtgccgtgggggtttgagcccaggtggggctgactgctgagcctgggcctttggatcatcagccgaggtgacttgcagctggttatctgcccacgtggccccttcccatgccggagggctcgggactccctgttcccatgactggggggctcagcagagagaggctgtggcctccctcag

SEQ ID NO: 204900 - DNA, 601 bp, Human
ggcccccactccatgtcggtgcccaccacacccaccctgggcttcagcactggcagcccccaggtgagtgcggggctggggcaaggggagggggtagggcctggggtggggctgtggcttcaactgcaggacgaccgcctcatcttgaggcctctgggaggtaggtgctgtggtctccccgcttgacgcagagtatacagagcctcggggagcagagtgccgtgggggtttgagcccaggtggggctgactgctgagcctgggcctttggatcatcagccgaggtgacttgcagctggttrtctgcccacgtggccccttcccatgccggagggctcgggactccctgttcccatgactggggggctcagcagagagaggctgtggcctccctcaggcctaagcctgcttccccaaaagcttgtgcccacacagcctgggtcctcccctgaagtctctgcttacacccaggccaaagggcccccagggaaggcgtgttcgggctcagggcagctgcgtcccctctcagggatgccggccctgggacctgcagtggccaggtgtggcagcggtgctctgtggtctcggctcccccacggctc

SEQ ID NO: 204901 - DNA, 601 bp, Human
gtccgtgctccccttcttccttggagaagacaccccgagtagtgtctcttgtggagttgttcccagccctggggtgtccggtctgtgagggtggagggcgaggctgggcctcgtcccctggctcccggtggttgcttgtggatttccacctggccggccggaacctcccagactcccactaggccctccctctccaggggctcctcacatgagcaggggtgctccttccgctctgaatttctgtgtttgggtttcaccctgtgttcctagtagctgaaggctccatggcagagttttggtgcatctcaggacagcccacccgggtgggactcgccctaggagctcctctgcccacacacagctgacagcaccagatgtgtcctgtggactcccaaaccccctgctgccctgcctcagtttacctagggcaggcactaggcccaagggattgcatgtgagggggccaggaggcagcaggtggacacctagtcccaagcccccatgccatctcccgggtagtccaggactgctcctgacctaggactgggctgtagttggggtctggagccggcctgctgcccatccacctggccctgtttag

SEQ ID NO: 204902 - DNA, 601 bp, Human
cttagtttggacgagctctgtccctccaggggcttcactttcgccttctgcagcgtgggggatcatgtgtgaccttggccagcccctgacctccctgagccgcagcctctgcatctgggacacccagggtttcccatgcagggagtgtcaagtgtgggtgcaaagcccaggcaccgcacccctctgcagacgtctggggctttctcttgccccttcagttccctcccttctctgagaagcgcacctgctgcctgtggacatgaacactgggcatttggtgagtcacacagtggccacccgsttctccagtgggagcttcatggcacccccactgtgctgagttgtcacgggggacctcctggcctctcgcagcccacctgagtcctgcagggaccaagcatccttgtaaagcctcacagcccacctgggcagatcgaggaagaacctagaagccagaacaagctggggctggaagactcattccaggcaccgaggtccatgtgaaaggaggctttgcggtggtttctgctttgcttgcattgagcctcaaactcttcctgtcccgtgagaaggggggatgggatttggaggcctgaggaag

SEQ ID NO: 204903 - DNA, 601 bp, Human
tcccctttccctctcaggtttggcgattcctggcctcttagtgggtccctgggtcatggtttgcacacacgtttgggggtgtgcctcagttcctcccatcgggtcccgtgccctgggccttgtggaggtgggaggtgctgtctggggtgaagatctgttggtctgtccctgtccccccgctctgcaggacacccttcctctgtcctctgctgtgctgctcctgaggcccaacacctgtgtggctggtgtgtcttacttcctccccgccagcccctggtggggtccccaaacaggacccacrccactgtctcaccgtcagggatgtcctgagtggccaccttggtgctgcagtttcatttcatcatctctcttgtgtatgtcttctcagccttaacggtcctgttgagaaatcagagcctctgccaggcgccgtgctcctggagggtgtcctccttgggctgcgaggctgagtgtggtgtatgggctggtgtgaggtccttgtgcctgcatagcagagctgccttccagagctggtgtggccatgcccagtgctgccagtcaggcctttctgatggggattcgtgtttcatggagtgctgac

SEQ ID NO: 204904 - DNA, 601 bp, Human
caggcaggagggctgttgacgcctgaggaatgaaaaggtgtcggcaccacaggcctggctgcagggagcagtgtccgtgaagtctgaggctgtcatcacacctggccctcggaagtcggtgatggcctttctgagccccgtcccggaccctccaggctgcactgactccttcctaaggccctgcagcccagtcatccatgtgcctgggatcatcagactccagctgcctgggccccccaaagcctggggacgacaccccatcccatcccagtggaaccgtgcagtgttggggctggggggactggaatcacctggtcagaccgctcccctggtgcccatcggtgactgggtcctgttaggagcagctcatgtgggggaccaccctggacacccccttcctgatccccacacatggtctcactcgccccatacctgtgagacagagaaatggggtatagagaggtgagccgtggggaggtctaagggccagcaccaggcgtggcccccatttcttgccggtccttcctgcttccagtccttcctcttggcagcgcataagccctggagaccagacttagggccgtgagagaaactgctgctg

SEQ ID NO: 204905 - DNA, 601 bp, Human
ttgggggttcccagtccgatggaaaagacctagcttccacccagggtcgtcgggggagacattggtctagagggggcagtggctgtcccccattctgcttcctcctcctccctcaggaaggctgcttcccatttccttcctgcctgcctttgcttcctgtgcccaccctccagctctgaaggactgggtgtggaaacagcagggtctggcgtgtgtgcacctatgtgtgcacgtgtgtgcatgtgcgtgcactgcagggatgtggctgacccacaggtctctgctgtgggaagggagcccyggctgggctcgagtgtggccctcttgccttctggcctgtgaactgggcaagtgaccttgcctcgcccagtcctcaggttcctcatctgtgatgggctgggggcatcaggaagacccctgcgagcttgggggtggatgagagtgctgtgcgtggctggtggtggggttggagagcagtggtcacgtgtgggtgtgggtgtggtatgtctgtgtggtgtatgggtgtgcgtgtggtgtgtgtgtgatatgtctgtggtgtggtatgtgtggtgtggtatgtctctgtgtgtctgtgtgtgta

SEQ ID NO: 204906 - DNA, 601 bp, Human
cagccattgccactacccaagccagaggagccagtgggcctggggatgcccctcggctccgacatgcctgcctcggagctgtctgcccttccccagaccccctccctcctgcttgaccctgaggggctgtggcaggtcagagatgtcctttgcttctgaggggctgctgcaccctgagtcctaggccagcttgtctctgggggcctgggaccccagtgatgctggggagggtccgcctgggcaggagtctcaggtcttcctgggaggactgggctgcggtgtgtgagtctcctctgcctcygagcagcctcccccgtgcctccactctgcctcctccagccgccacgctctggtctggagggtaaagaggctctgtgtttacagacacctcccgcccggcctccggcgccagcggaacatgagtcaagcatgacttcgtctagaaggtgattgtgctggcaaagcataaatcccggcccctcctgccccccagcctataaataaagcgatcatatttataatgatgctgggcagagctgccaggcccttcacagcttcaaagtgcttcacaaaacactcgctaattaattctcggctgccc

SEQ ID NO: 204907 - DNA, 601 bp, Human
tggcaaagcataaatcccggcccctcctgccccccagcctataaataaagcgatcatatttataatgatgctgggcagagctgccaggcccttcacagcttcaaagtgcttcacaaaacactcgctaattaattctcggctgccctggcggaggaggcaggtgccaaggagcccagctccaggcacctggggagaactggcagcaaggcccctcgctcagggccacccttgtctggggctccccatgccctggggctacctctgagcaggagaaaatccctggcaccgggccgggctggcrcgtggggtgggaggctccggtgacagctctgagcacctccaggccccccgtgtgctggcgcttcctcttggagccatcctgggggtgggcgctgtcattttcatcttacggatgagggagccgaggcacagagaggtcaggggacttggccggggccacacggctgcttgggctgtggcaggctagcaggctctgtggggctggggttgtcggatcccagggcctgcagctttaggctgctcactgtcttgagcgctcagccctgcccctttggctctcagagcctcagcttccccactg

SEQ ID NO: 204908 - DNA, 601 bp, Human
cagagaggtcaggggacttggccggggccacacggctgcttgggctgtggcaggctagcaggctctgtggggctggggttgtcggatcccagggcctgcagctttaggctgctcactgtcttgagcgctcagccctgcccctttggctctcagagcctcagcttccccactgggaagacagcagtgccagctatgtcttggcactgagactttagaattctgcccttgctgcccatccttagggtctcagggacctgggccagtggaggtgccgtacccctcagctcagatgctggctgasatctgcgtgtgcgggggcttcctgccccgggggctgctcagcgtgggtggggtcggctctataggctcaggaccctgtatggagggtcgtgtcagtagtgaccccgccccggatgagcaccgccctctggagggctcatggaagtcccatgtgggggctgaccggagccttctgcagcctctgccagacccttgccatttgcccaccagccctgctccccatcctgcccccacccaccatcaggtttccagtagggccaggcctgtgcatgccgactgcggggtccctggctggctcctc

SEQ ID NO: 204909 - DNA, 601 bp, Human
gcggtggctgctgttgatacaggaagcagctctgcagccccccagctggtcacccccatgctgaccctcctgccccctcccaccccaacagcctcaaggggaggaggattgggtgggccgcagccctggtcccgggctcttctcctgggctggctccagctggtcctggaggtgttggattcaagaccccctggcctcgccctcctctccttggaccctccctgttactggctcgctccctgtggcatctttgcttctggctgtggccttgccagggagggcagcacaggggcgttctgarcccctcctaccctaccctaaggcctaggaacctgtgctgctcgggaaccattgctccctggtgagcttgtctggctgggagaccccacctgtcccaggccccactgagggggtggctccagctgtgcccggggttgggcaggtgagctcctggccacccgtgtgaaggttcaggactgtgcagtaagcttcctgctgctggggacctgggtccagctggccctcagggcccatgtgtcttttgccatggtcaccatggtgtccagtcttcatctgtgtctccgtgtgggtttggggctgg

SEQ ID NO: 204910 - DNA, 601 bp, Human
gctgctgttgatacaggaagcagctctgcagccccccagctggtcacccccatgctgaccctcctgccccctcccaccccaacagcctcaaggggaggaggattgggtgggccgcagccctggtcccgggctcttctcctgggctggctccagctggtcctggaggtgttggattcaagaccccctggcctcgccctcctctccttggaccctccctgttactggctcgctccctgtggcatctttgcttctggctgtggccttgccagggagggcagcacaggggcgttctgagcccctyctaccctaccctaaggcctaggaacctgtgctgctcgggaaccattgctccctggtgagcttgtctggctgggagaccccacctgtcccaggccccactgagggggtggctccagctgtgcccggggttgggcaggtgagctcctggccacccgtgtgaaggttcaggactgtgcagtaagcttcctgctgctggggacctgggtccagctggccctcagggcccatgtgtcttttgccatggtcaccatggtgtccagtcttcatctgtgtctccgtgtgggtttggggctgggaccag

SEQ ID NO: 204911 - DNA, 601 bp, Human
gcacaggggcgttctgagcccctcctaccctaccctaaggcctaggaacctgtgctgctcgggaaccattgctccctggtgagcttgtctggctgggagaccccacctgtcccaggccccactgagggggtggctccagctgtgcccggggttgggcaggtgagctcctggccacccgtgtgaaggttcaggactgtgcagtaagcttcctgctgctggggacctgggtccagctggccctcagggcccatgtgtcttttgccatggtcaccatggtgtccagtcttcatctgtgtctccrtgtgggtttggggctgggaccagagccctgtggccaccgaagaccttatacaggccgaccatgaggttgccccaacctctgtccctctgtgggcccaggcacaccagcctgccctccgtgctgggtgcgccctgcaggtcactgtctccccaacccccagggccttcgtgcttgcagctcacgtggcctggaactgggccctctggctcttccccaggctttggtctcagctgaggtacctccggccttcatctgtgcccctgccagggtggggactgcccctgtgatgtgggctgagag

SEQ ID NO: 204912 - DNA, 601 bp, Human
gggcaggtgagctcctggccacccgtgtgaaggttcaggactgtgcagtaagcttcctgctgctggggacctgggtccagctggccctcagggcccatgtgtcttttgccatggtcaccatggtgtccagtcttcatctgtgtctccgtgtgggtttggggctgggaccagagccctgtggccaccgaagaccttatacaggccgaccatgaggttgccccaacctctgtccctctgtgggcccaggcacaccagcctgccctccgtgctgggtgcgccctgcaggtcactgtctccccamcccccagggccttcgtgcttgcagctcacgtggcctggaactgggccctctggctcttccccaggctttggtctcagctgaggtacctccggccttcatctgtgcccctgccagggtggggactgcccctgtgatgtgggctgagagcacctgatcttttctctgtggcccctggcactggccaccacagggtgaggtgtgttcacagggtaaggtgtgtggtgggttaatttctgcccccacgaggctgctggtgatggctgtgctgctcctcaccaccagcttcggtcaaggacagcg

SEQ ID NO: 204913 - DNA, 601 bp, Human
agcaagtttggcagatgcacaaagggctgccaagtttttatttcgtgaaggacattatttgggggggaatctgccatctgctgtctccgccactgcctgaaagttcagggagtttagaaccacagaggcaggcagggctcgctggggataaaggacacgtcttccacggggagggggtctctctgtgcccgctcactccctgctctgtctcatctcacactgaacgctcctctgtggactggcctgggtccaacttccagaaccgctcactgggccccttctctcagatgggcaaactgargtccagagagggggcgacctgcccagcgtcacggtcctggtgcctggtttctccccagcgcggggcagggcctgggcgggtcctgtggacacttctaggcaggagtagagcccatcacacgcctactgttacatgaggcacgttggatctccaggcgagaatgggaggctcacagaggttaatcctttccccaggccacacagggaggtggagccaggatcctgcactatccctccctacctaggggaccccctccaggcctagccctgctggtactggagcgagagcctcacacctgcc

SEQ ID NO: 204914 - DNA, 601 bp, Human
ggatccccagcagagccactgctgcagacacggtgctcggggctggttcccatatccccccgcccctgccaggcctgcttcatcctttctcagggataccctgcagccgatgggcaggcgagaaggatgggcccctttcagcccccagcgtgacagaaggagaggctgaggctaagaagccagcctggctgtggcaggcctggggggcgctgtgcacagatccgggagccctgtgagtgctgggggctgtggctgctgctgatggaaggtttgtggaggaatgagtgagtctgtgtagactgtggtcaaccccactcagccgagggatcccacccctgtgtataccccttctggctcgggcccccaagggctgccctgccctcttccgagggtcctggcgagtctctgtgccattcctcgggggccttctcactccgccctcagaggcctttcccgccgggcgctgcgtttaggctgcacgtctctgatgagcagatggttgctgttggtggaagctcttcaaagggaggcatttttctccttggcagatgccctgaagtgagggatccccgaatcctattcacagtcgttattcctgcag

SEQ ID NO: 204915 - DNA, 601 bp, Human
ccccgaatcctattcacagtcgttattcctgcagcggcaccactgagggggccgtcatctgagttcccattgctcaggacacagaaggtccgtgacccaagccccacctgccaggagctgaggaggggcctcccctcctgccctgttcaaggctgcctgggtcccctcatctgtgagactgaatggcccccttccggctaggactttccaaaggagccgtgaatgctgctctctctgtgcctggggcctggtatctcagccgaggctcctgccctcctgagctcccacatccatgcctgayggaacgtgagaggccagccctgtccccagcgtgggccaccttggccatcagagatgaaggtggttggtcccaccctgctccagtgctgcccatatccagtttcgtcagctcgccgcacctgccttccagagctgtgggagagactcgtgcgtcctgctgtaacccagtggctggaaacaacacacattttattatatgactgttctgtggccagagagccaaaagcagtcttgccgggctgacatcaaggtgcctgccggctggctcctggaggctctgctggggagtctgccctggcct

SEQ ID NO: 204916 - DNA, 601 bp, Human
ccagcagaggccctgagcgtttgggcagggccacgagggatctgcaggagtaagttccttgggaagggccagcctcttgagttggaggacatagtgaccaagggagcagccccaggcaagactctttgtcctgcgcttggagcctggagtaagacctggtatcctctgcatcactgaggtcctccttctgaaaggccagcgcaccctgagccgtttaaagctgtgtccgtgccgggcccccacatcacagggccaggagccctccttcctgcagcgatggagcacttaggaaggtgaagayaccccaaaggttactgtaaagtgggttcctctcctatttttctcttacatccgagaaggaggagggcagcttacaaaggtgtgtggggcaggagaggagaaataaccgagtgaggacatcggggtggagggacaggggacaggggagctgagatgcagccggcgtgccggagggtgcagagagagactccgcactgttctgtccgtgtgtctgggctcctgacctgtatcccgtgctgagggccgcacctcggctcagcagcgccttctgaccccagccgtgcactaggcccctctgctg

SEQ ID NO: 204917 - DNA, 601 bp, Human
gggcacagggggacccagcaaggcagttgtcatgaggggcttggtggtgccgtctgggctccgcggttcacagtgttcatcactgtgcgtcggaatccagactccgaaagtggccagctgtggttgtgaacttccggtgctgaagttcaggagtcccaagccctgcaggctggggatgggtcaggcctgccgggtgttccagaggggaccaacctcatccccaagcctcgggtccagggtgtttctggggctgggcccctgtggttgaggagagcagggcttggggctgtggggctggggmtgggcacaggcctcctggccgacagtgcggcccttctccagcctctgggttctcggcttgaaaagcctcctaggtgctactccttcgcccaacaagtgctgacacgtgcctgtttgctcggtgccctgctggcatgggagggccccttcaagctgctggatagggcttgcctgcctagagcttggggtttagagggtcacgcccaccagcaggcacccccggcacgtgagggcaggagcacggttggtcgagggtgcgggccacttcctccgggagctgcaagttaggggccaggggagt

SEQ ID NO: 204918 - DNA, 601 bp, Human
gggcacaggcctcctggccgacagtgcggcccttctccagcctctgggttctcggcttgaaaagcctcctaggtgctactccttcgcccaacaagtgctgacacgtgcctgtttgctcggtgccctgctggcatgggagggccccttcaagctgctggatagggcttgcctgcctagagcttggggtttagagggtcacgcccaccagcaggcacccccggcacgtgagggcaggagcacggttggtcgagggtgcgggccacttcctccgggagctgcaagttaggggccaggggagtgrgaggcacggaggtggggtgggctggtggaggcagcccaggcagggccttgaaagtcttgctaagtttgggttttttcttggggccacagggagccaagtcctgaggggttccagccgggagggagctatgggtttctgtgtttggaaactcagctcattgcgtgataggggcaggtggctggggtgtggagggagaggtttggggctgctgtggggagctcacttgggctatggtggagggagtggagccctctcggctcctggccctgaccttctgaccttgccctttgtcagacctgg

SEQ ID NO: 204919 - DNA, 601 bp, Human
ctcctgggggcagcagcgctatctcccatccatgttatggggctgggacccaagggcagcagcagcatccattgtctctcccagttcccaaggcggctggaaggaaggcagcagatccctgacactttatcgatggggaaaccgagtctctggaggtcaaatagttgacccaaggtcacgtggctggcaagtggcagagctgagcctggacccagagcagcctggcctggccgtgggttccacagtcgtccccctgccaccaggctctgggggagcgggcggaggcatgtccagcggcatycctccaccacctgctctgcccatggtggggcagcctgggagaccccacacaagcctgggtcctgggggcaggtgcccgagacacgccccagctgagggttctgacctgtggcttcttcctttcagactccaaggggctctcgaacccggccgaggtggaggcgctgagggagaaggtctatgcgtccttggaggcctactgcaagcacaagtacccagagcagccgggaaggtgggtcccgccccgtcccacacacaccccagacccaggctcttgtctccagagcccccaccccctgca

SEQ ID NO: 204920 - DNA, 601 bp, Human
ggctgtcctcttgtgtccctcccctctctgcctcacgagtgttggggttcccacgtcattccaccttcagcccatttctttacactatgcggtctcagatttttgtattgccgtctctgtggtgatgactttaaacctgtatctgcagcttcctcctgtggctccagcctcagaggaggccagacaccttcacctagttttttcacaagcacttcacactgaccacgtccagactcagctcatcacccatgtgatgctcagcctactcctacttctctgtatttctctgtatttctgttgyggcgcctttccattcagtgaaccaaggcccccaaggctaagtcacttaaagccattggtttctctccctagagttttactctgtccagcctcttctctccaccctgcgcttcctgccagcgccctgagctaagctctcatcctcttgcctggaccatgcaccttcctcactggccttgcctcaagcccagggtctgtctaaacggccagtgtggccaggtcattcctcgctggcagcattttctgtcagctgtaggtctgtgagacaccccaccatgggccccatcagacctcgccagcc

SEQ ID NO: 204921 - DNA, 601 bp, Human
tggtgacttattaggatgtaggtggaggatggctggaaggaagaaacatcaaaggagaacgagggctggttcccacagactacgttgaagtaagagcttcctgtcattcattcattagagctcatctttgccaggcatctttttatgaattatcaacttacaagaagtcagcaactttttgcaaaacaaaatttccattgtaaatataataaatgttaactatataaaatatggaaactacattgaaatagaactaagaaaaatattacctgtagacccaagcttcaaagaatgactacaratatttaggttaagtttcttccagggatagcaacttttaattggtctgaataaaagttagtatttttcctttgctaatattatctatattataaatatatattataaattgtataaattcaataagatatatgaaattatatctcaatatatctgttaatatatacattttaaatatatatttatatttttataagcaaaatatataaattttataaaatgtattataaattatataaattataaatatagatatatatttataatatgacacatataacgtatttttcctttgctgata

SEQ ID NO: 204922 - DNA, 601 bp, Human
aatatatacattttaaatatatatttatatttttataagcaaaatatataaattttataaaatgtattataaattatataaattataaatatagatatatatttataatatgacacatataacgtatttttcctttgctgatattgctgccatctataatattgtttattgtacaatagactcacagtttaaatagatttttttaagtgcatatctcagttccttctcccattcccatagacagaggggtgtcttgggggagctgctgtggggatctcctgggtagagctgttaggatggrtacccaggagagcaacacagcagcctgggctggtcctgcctgggacacccccaagctgagccaaccacctggcgccccctgctggttgtctttcggtccctccaaaccgagcgaaggttcttggtaagcttgtctttcatgttgggtgacagaaagaagcgaaggtttcctgatgccctgtgagtacaactggagctagatcaagaataaaggtacctttggttcacctccaggagaaaagaattccccccagaggatgtttacctgggacctgtctgcagagtgagatctaaggccgtc

SEQ ID NO: 204923 - DNA, 601 bp, Human
cccacaaattgacaagattgagaaaaatctgagaatttaagttgatattggcagtaattggattttctaggattctgcttatataaaggaatagtgattacagatattcttgggtttgcttacctttaagaatataaaaccccctctattagaaatagatcctgcaggcagaaaatcagtaaggacgtggttgaactcagcaccatcaataaattgatgtccacttagggacatctatagactgcttcatcaaaccacagcagcatacacattcttttcaagcttacatggaacattctcyaagacagaccacatattctgagccataaaacatacctcaacatgtttgaaagaaatcatacagtgtctgccctgagaccacaatggaatcacactagaaatcaaaacagaaagatagatggaaaatctgtaaatacttagagattgaacaatccacttctaaataatgcatggatcaaagaagaaatctcgagaaattaaaaaatagtttgaactaaataaaaatgaaaatacaacccattaaaatatgagtatgcggcaaaagcagtgcttacagagaaatttgtagcattgaagaata

SEQ ID NO: 204924 - DNA, 601 bp, Human
ttacagagaaatttgtagcattgaagaatataaaccctttttgacaattcttgcttgccctcgaagactccctgaagtgaccgtaatctatgaaaataattgcggctctttctcctattcagattttacccagtgatggaaaagatcaattttcttgtggaaattcagtggctgaccaagccttccttgattctctctcagccagcacagctcaggccagttcgtcggctgccagcaacaatcaccaggtacgtctcacttcctccttctggatgtggctggctttacggaaaacagagcrtatttgtgaaggcttgtgatgcattatagctattgccattccccaaaagcaaaaacaaagtcgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaactgcaaataccctcttagataaaggcatggaaagaagacgaagaagaggaggctcttgttgttgaggaggtcagtgtca

SEQ ID NO: 204925 - DNA, 601 bp, Human
gaagactccctgaagtgaccgtaatctatgaaaataattgcggctctttctcctattcagattttacccagtgatggaaaagatcaattttcttgtggaaattcagtggctgaccaagccttccttgattctctctcagccagcacagctcaggccagttcgtcggctgccagcaacaatcaccaggtacgtctcacttcctccttctggatgtggctggctttacggaaaacagagcgtatttgtgaaggcttgtgatgcattatagctattgccattccccaaaagcaaaaacaaagtygcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaactgcaaataccctcttagataaaggcatggaaagaagacgaagaagaggaggctcttgttgttgaggaggtcagtgtcagagcctcggcctggatcaggaaatagatgccctggccctggcatgttgcttacactctcaga

SEQ ID NO: 204926 - DNA, 601 bp, Human
tcctccttctggatgtggctggctttacggaaaacagagcgtatttgtgaaggcttgtgatgcattatagctattgccattccccaaaagcaaaaacaaagtcgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaactgcaaataccctcttagataaaggcatggaaagaagasgaagaagaggaggctcttgttgttgaggaggtcagtgtcagagcctcggcctggatcaggaaatagatgccctggccctggcatgttgcttacactctcagagctagaggccctcatcctgcgagtagaagcagtgcctgtgaaagtctaccagatccaggcactcagcacttggtactcttattgtattgcttccaggaaacttagaatagtgggataacttgagaagaatacaaggaaattttacattaattttaattaaaatttgactagtttaggtgaatttgtctagttcattta

SEQ ID NO: 204927 - DNA, 601 bp, Human
tcatttattgccaaatgatgacacagagtaagtgacaagaagaaaattgagaagacaggtatcaaaatattgttgctgctgggcacagtagctcacgcctgtaatcccagcactttgggaggccaaggcaggtggattgcttgagtgctggagttcgagacaagcctgggcaacacgatgaaaccccatctccacacgttaaaaaaaaagttaaaaaaaaagaattaaaatattgttaactgcttacatctttagaaatgaatgggctttaggagatgttatttcttgattttttttttaactacataaaaggttttaaattctatcaggcctgatgataatcatatcacttacaagtatttgcttataaaatatctgtttattagccaggcacagtggctcacgcctgtaatcccaccagcactttgggaggccgaggcgggcggatcacctgagttcaggagtttgagaccatcctggccaacatggtgaaaccccatctctactaaaaatacaaaaattagctaggtgtggtggcaggcacctgtaatccaagctgctcggggggctgaagcaggagaatgacttgaactgggaggcg

SEQ ID NO: 204928 - DNA, 601 bp, Human
tgaccttccaagtgagtttatataagtttatcaccatatactaactgcaggttttatacatttcaaaacagctttttgtagacattctgaattacaaattagactcagatatttaaaatttgcaggcaaggtgattgatcactgtaattgaagaattctcttctgtattttattattctatactacttgagaacattggccaggtaagggttactcactgtgaaacgtgaatagtagttatacctcactggaagttttcccaggggttctcaacctgagcctcattgccgtttgaggcccygcgccctttcctagtggggcgggcccatcctgggcactgcaggatattgagcagccttcctagcttctacctaccaggtgccagtcacatgcacgccacctcagttgtgacaaccaaaaatgtctccagatatagccaagtgttgcctaggagcaaagccaagccagttgagattcactgagttatacagaagcacccatgaaatgggtttgcattaataaaggacaagattttaataaaagaattgtaatgaggtaatgagatcatagaataagtgaggcaaacaaaaaatagaaatat

SEQ ID NO: 204929 - DNA, 601 bp, Human
gagttatacagaagcacccatgaaatgggtttgcattaataaaggacaagattttaataaaagaattgtaatgaggtaatgagatcatagaataagtgaggcaaacaaaaaatagaaatatttatcttattttaattctagggactgaccagctattatctcaagataggtggaggcagtttagctaatgaaaagaaattaaaactcagatttaagtcatgttctgttaggaaatatattccttggtatttacttgtagtttaatataaactggtataagtctaaaatttgtttcgtttargttatttagaaggtaataaaagaaaaaaaaagcggggggggcatctagtctaacattgaatctaatcagatcctttgaaagcaaagaaaaatgaactgaaactagaattaacaaaatgcagaaagcatagccgtcattaatttgagcatttgaatttaatgtaaatcaagtaaaaatattttaactgctatctctgccctctgttatctgggatatgagaacaatttaagtaggccaaaatttgggtacattttgtaaataccatgaaagatgtcacgagtaggaaaccagatgaccatt

SEQ ID NO: 204930 - DNA, 601 bp, Human
aaggacaagattttaataaaagaattgtaatgaggtaatgagatcatagaataagtgaggcaaacaaaaaatagaaatatttatcttattttaattctagggactgaccagctattatctcaagataggtggaggcagtttagctaatgaaaagaaattaaaactcagatttaagtcatgttctgttaggaaatatattccttggtatttacttgtagtttaatataaactggtataagtctaaaatttgtttcgtttaggttatttagaaggtaataaaagaaaaaaaaagcggggggggcatctagtctaacattgaatctaatcagatcctttgaaagcaaagaaaaatgaactgaaactagaattaacaaaatgcagaaagcatagccgtcattaatttgagcatttgaatttaatgtaaatcaagtaaaaatattttaactgctatctctgccctctgttatctgggatatgagaacaatttaagtaggccaaaatttgggtacattttgtaaataccatgaaagatgtcacgagtaggaaaccagatgaccattaattggtagctttttaaacattttcctatcaggtttgccca

SEQ ID NO: 204931 - DNA, 601 bp, Human
actgagtagtctcaggtgagcagagttgctggtgtcaaggcagtgttgctgcatccaggtccctggcccactgtgattgctttcctcttttggtggtgagaaaacgctttatcagccaaaacgcagttcagcttggctgcagtttagactagaattgtcagtgtgaaaggaatatgatgagttgttctttaaatggactgaaacagtttgatttggaaaattataaagctgtttattaaactacttggagaaaataatagacagcattttttttatgatcttggaatatggaagcccaccwttttttttttttttttgagacggagtctcgctcagtcgctcaggctggagtgcagtggcgtgatgtcagctcactgcaacctctgcctcctcctgggttcaaatgattctcctgcgtcaatctcctgagtagctgggactacaggtgcccgccactacgcccaggtaatttttgtatttttggtagagatggggtttcaccatattggccaggctggtctcaaactcctgaccttgtgatccgcccacttcagcctcccaattgcatccggcctatggaagccctttctgagactgacag

SEQ ID NO: 204932 - DNA, 601 bp, Human
ggtgtcaaggcagtgttgctgcatccaggtccctggcccactgtgattgctttcctcttttggtggtgagaaaacgctttatcagccaaaacgcagttcagcttggctgcagtttagactagaattgtcagtgtgaaaggaatatgatgagttgttctttaaatggactgaaacagtttgatttggaaaattataaagctgtttattaaactacttggagaaaataatagacagcattttttttatgatcttggaatatggaagcccaccattttttttttttttttgagacggagtctcrctcagtcgctcaggctggagtgcagtggcgtgatgtcagctcactgcaacctctgcctcctcctgggttcaaatgattctcctgcgtcaatctcctgagtagctgggactacaggtgcccgccactacgcccaggtaatttttgtatttttggtagagatggggtttcaccatattggccaggctggtctcaaactcctgaccttgtgatccgcccacttcagcctcccaattgcatccggcctatggaagccctttctgagactgacagcacaaagtctagtggccattaaggatataa

SEQ ID NO: 204933 - DNA, 601 bp, Human
ttcaccatattggccaggctggtctcaaactcctgaccttgtgatccgcccacttcagcctcccaattgcatccggcctatggaagccctttctgagactgacagcacaaagtctagtggccattaaggatataattgatacatttaagtaaacaagtaatattaaattagcaaaaatacttctgacttatgacggatacaggctaattccattcatatacatacactcttgctaatctgtaagaaaaagatgaagaattcagaaaaataggtaaagtgtataaacaggctgtcctttggtgggggaaggtactaatagttaatatacttgggaaaatgctcattttaagattcttctatcaaactagcagagaatgaaaacagtttaaaagctagtgtcatacaggtgtggtcagacaggcaatgtcatacaaagcgagggaaaggataaagtgatgaagcttttcggggctggttcggtaatgtatatgagtatttacaatgcatatctctaaggcccagcggttctgagttcctcctgcagatctgctcgcagaacgcaggtttctgggcaagaacgtttcctacggcattgtttgta

SEQ ID NO: 204934 - DNA, 601 bp, Human
ttggccaggctggtctcaaactcctgaccttgtgatccgcccacttcagcctcccaattgcatccggcctatggaagccctttctgagactgacagcacaaagtctagtggccattaaggatataattgatacatttaagtaaacaagtaatattaaattagcaaaaatacttctgacttatgacggatacaggctaattccattcatatacatacactcttgctaatctgtaagaaaaagatgaagaattcagaaaaataggtaaagtgtataaacaggctgtcctttggtgggggaagrtactaatagttaatatacttgggaaaatgctcattttaagattcttctatcaaactagcagagaatgaaaacagtttaaaagctagtgtcatacaggtgtggtcagacaggcaatgtcatacaaagcgagggaaaggataaagtgatgaagcttttcggggctggttcggtaatgtatatgagtatttacaatgcatatctctaaggcccagcggttctgagttcctcctgcagatctgctcgcagaacgcaggtttctgggcaagaacgtttcctacggcattgtttgtaacagcagaa

SEQ ID NO: 204935 - DNA, 601 bp, Human
gtgtcatacaggtgtggtcagacaggcaatgtcatacaaagcgagggaaaggataaagtgatgaagcttttcggggctggttcggtaatgtatatgagtatttacaatgcatatctctaaggcccagcggttctgagttcctcctgcagatctgctcgcagaacgcaggtttctgggcaagaacgtttcctacggcattgtttgtaacagcagaaaaccggaatgtaaatgtctgtcagcaggggactgatcagatgaactataggcagccacgcagtggaaagctgagcttcccttagggagagtgagggtagatttagatgtacagatagaggtatgatttttttaaaaggcacctcagtatgggtaatgttatctttcttgtgtttcagtgcacacacatacacacacaccatagatgcaaagtgtgtagaaaatgtattgaaggatacccaggaactgaatcaaactctcttcattttcttattcaaatacagattttatattacccagataaggacaaccattttattacctttgaaaagaaagcatagtttttagtggttaatattagtttcattattagttacttatcggttat

SEQ ID NO: 204936 - DNA, 601 bp, Human
caggtgtggtcagacaggcaatgtcatacaaagcgagggaaaggataaagtgatgaagcttttcggggctggttcggtaatgtatatgagtatttacaatgcatatctctaaggcccagcggttctgagttcctcctgcagatctgctcgcagaacgcaggtttctgggcaagaacgtttcctacggcattgtttgtaacagcagaaaaccggaatgtaaatgtctgtcagcaggggactgatcagatgaactataggcagccacgcagtggaaagctgagcttcccttagggagagtgasggtagatttagatgtacagatagaggtatgatttttttaaaaggcacctcagtatgggtaatgttatctttcttgtgtttcagtgcacacacatacacacacaccatagatgcaaagtgtgtagaaaatgtattgaaggatacccaggaactgaatcaaactctcttcattttcttattcaaatacagattttatattacccagataaggacaaccattttattacctttgaaaagaaagcatagtttttagtggttaatattagtttcattattagttacttatcggttatttcacagt

SEQ ID NO: 204937 - DNA, 601 bp, Human
ttcttgtgtttcagtgcacacacatacacacacaccatagatgcaaagtgtgtagaaaatgtattgaaggatacccaggaactgaatcaaactctcttcattttcttattcaaatacagattttatattacccagataaggacaaccattttattacctttgaaaagaaagcatagtttttagtggttaatattagtttcattattagttacttatcggttatttcacagtttcaagagtatttcacgttagtggctgaaccactagaatgaatggaccagctgatgggaatgaatctcarttgttaaaaatctctactcctgtgtgtgctagtcttgtttttcatcagttattgttgtttagattacatcactgctgtgattctgaaaaggtttcagtatagatcttaaactctcagattactgcttctttagagtacttacttttgagaaattaatagaaagtttttgtttgtacctttctaaagaatgagaacaatgaggtttaaaagctacttaaaagttctgtaaacctagatgtcttatctgaaggttttctacttgagaggtttgttttctgtctccttcaaatactagaaaga

SEQ ID NO: 204938 - DNA, 601 bp, Human
gtttcacaccccgccagtccccaggtgagtggtgtggtgggaagcatgtaagctttgctgttagatccaggcttgccagtgcggctccactgtgtaagaattgtggctttggcataagacctgcctcctgaacctcctgaatagtcagtggattaggccaccaatataaagtagtgccggacacatggaagatatttcataaatattttccttcttttcccacttcttccctcctttaaaagggggtcttcaatccacttacccttttgtgttccagcctctctcactattctaccctctytaatcgtgtagattcccttataaagtgtctctctaatcttgaattttctctttgatttgcccaatttctagctttttgttgaacagttctatcagcatgtctcctttgtatctgaaattcatcttcaaccgaatcacttatttccccacaaaactagtttctcttcctgactttcctgtttctgtttctctgaaatgttacttctttctgtgccctctttttattctgctttaaaaccctaaccgagtgccatcgtgagccacagttattgagaggcgtgctctgcatccttgagatgtg

SEQ ID NO: 204939 - DNA, 601 bp, Human
aagagttctaaagtatttagaagagtacatggtacttagtagtggtttaataattgttaattatagttatctcatataccactgcttctaaaacaagacattaaggacaggcacacttcatttattgccctttgctttattgcacttgacagataatgcattatttacagattgaaagtttttggcaccccctgcattgagcaagtctatgggcgccattttgtcaacagcatgtactcacttggtgtctctgtttcacgttttgttaattcttgcaatgtttcatactttttcatcattattatatctgttttgatgattcatgatgagtgatctttgatgttactattgtaattgttttgaggcaccacaatggcgagcttaattgacatgttttatgtgttccgcctgttctacccgccagccataccctcgtctttctccctctccttggacctccctattctctgagacacaaccgtatttcagttaaccaattattaaccctgcagtggcctctaagtgtttcagtgaaaggaagagtcgcatttctctcactttaaatcaagagctagaaattattaagcttagtgaggaaggc

SEQ ID NO: 204940 - DNA, 601 bp, Human
ttttttggtagtccatttaaaaataaattgataaaagaaaccctcacaaaggttcagtattagatgtgcttataccttcattaactcacataagtcttataatgccttagacatctcgtaattgcttattgagactttctctttacagaactttattgaaaaggttctttccatctcttcactctcactcccacccccccgtatgaattctttttagttggtaatagggctttttaaggaagatcatataccagtgttagaggatttatggacatttgccttcagaactgcatgaggctgycattactaaccttgtgtgctttttcacagatccctgacatctatgagacagctttgttcatctcaggaacctttcaaaaatacatgctggtgaagtttgttatatagggtggtttttgtttgttttgtctaactggaaacaaactattaaagcaaagtctttttttttaaccttaaaactgcagtgatgaaggaccagccagcattgttatacgtacatcctgtcatcagcacagtgtaaaagcttatttcacatggacttctcttaggtctgtctggaagcaaattatttgctgattgt

SEQ ID NO: 204941 - DNA, 601 bp, Human
catctcaggaacctttcaaaaatacatgctggtgaagtttgttatatagggtggtttttgtttgttttgtctaactggaaacaaactattaaagcaaagtctttttttttaaccttaaaactgcagtgatgaaggaccagccagcattgttatacgtacatcctgtcatcagcacagtgtaaaagcttatttcacatggacttctcttaggtctgtctggaagcaaattatttgctgattgtagcgccatcctattctgtactcaaagctacctattttaggactttgagctatctgagtragtagactctctaagctaatacaaacattatccatttaccttaagtaaatttttagtgttttaattatctttatttaaaaaataaacacctgaaattgacatctgtaggttcagaatatgacttaacaaaggatttgttaaataatttcacctcttttggtaattcccaatcagtaatgttgatatgactggctataaatagattgagtctgctgtgatctaccttcatttttagaagaatgtacaagttttatgttccaccagtggttttctaacgtcagtacagattcatctgtagaa

SEQ ID NO: 204942 - DNA, 601 bp, Human
ctgttgttgacctttacagtaaaaatatttctgtcttcttcctcttttatgtatctgaaggtaacagaacgttggctggaatagaaaatatcttaagcctgttatctcttcaattaaaagtctctattaatatgacctggctgtgcagctatttgtaaatataactgtctggtcttttcctgcatagcataagctaataggtatgttacttagatggggatttactcaaagaaatgctagtctttattcttttctttatattttagatgagccctcacatattaagataacctctactgamtgcatactgtgggctagatgctttgtatgcattatgtcatttaatccttacaggaggataatgttatagccattgtataagtgtggggactaagagagctaagtaaattacccaaggccacacagctagtggtaagtgataaagctgggattcaaacccagatagcaggctttgagcctaagttcttaaccactatccccatgtggtataatgattacttgagtcaattccaatagcttcctaaagggagttaaactccacctagtgtaccaggattcgtcttgcccctttttatcccat

SEQ ID NO: 204943 - DNA, 601 bp, Human
gaaaatatcttaagcctgttatctcttcaattaaaagtctctattaatatgacctggctgtgcagctatttgtaaatataactgtctggtcttttcctgcatagcataagctaataggtatgttacttagatggggatttactcaaagaaatgctagtctttattcttttctttatattttagatgagccctcacatattaagataacctctactgaatgcatactgtgggctagatgctttgtatgcattatgtcatttaatccttacaggaggataatgttatagccattgtataagtktggggactaagagagctaagtaaattacccaaggccacacagctagtggtaagtgataaagctgggattcaaacccagatagcaggctttgagcctaagttcttaaccactatccccatgtggtataatgattacttgagtcaattccaatagcttcctaaagggagttaaactccacctagtgtaccaggattcgtcttgcccctttttatcccatattgtatatttgtaccatgtgcagctttcctacactcaccacacagcaccaccatgggtgtgcgtgtccgtctcccccacccc

SEQ ID NO: 204944 - DNA, 601 bp, Human
caaagaaatgctagtctttattcttttctttatattttagatgagccctcacatattaagataacctctactgaatgcatactgtgggctagatgctttgtatgcattatgtcatttaatccttacaggaggataatgttatagccattgtataagtgtggggactaagagagctaagtaaattacccaaggccacacagctagtggtaagtgataaagctgggattcaaacccagatagcaggctttgagcctaagttcttaaccactatccccatgtggtataatgattacttgagtcmattccaatagcttcctaaagggagttaaactccacctagtgtaccaggattcgtcttgcccctttttatcccatattgtatatttgtaccatgtgcagctttcctacactcaccacacagcaccaccatgggtgtgcgtgtccgtctcccccacccctcgtggccattctcagtctgttctgtggtccagtggctctgcagtcaggtacaagccagtctactttctgaagaaatttagctaatgctgtaaatcctttgagtgaatgtgtttaaataagtctcccaatgtcaagcctgcat

SEQ ID NO: 204945 - DNA, 601 bp, Human
aggataatgttatagccattgtataagtgtggggactaagagagctaagtaaattacccaaggccacacagctagtggtaagtgataaagctgggattcaaacccagatagcaggctttgagcctaagttcttaaccactatccccatgtggtataatgattacttgagtcaattccaatagcttcctaaagggagttaaactccacctagtgtaccaggattcgtcttgcccctttttatcccatattgtatatttgtaccatgtgcagctttcctacactcaccacacagcaccaccaygggtgtgcgtgtccgtctcccccacccctcgtggccattctcagtctgttctgtggtccagtggctctgcagtcaggtacaagccagtctactttctgaagaaatttagctaatgctgtaaatcctttgagtgaatgtgtttaaataagtctcccaatgtcaagcctgcataaatatatttctctatttgcattatgaggagaggatagcttttaaatttagaacgttaaaccagcaaattgttagtatattgctcctgggcctaaaggggcatttgatttagctggggtgggagttagg

SEQ ID NO: 204946 - DNA, 601 bp, Human
gctcagacgagagtgattgtatatgtcgattttgtttgttgcattttccaatgtttgttaaaatttcaagcatagaagagttaaacgaatttcatagtgaataatcatatacccaccttctagattttaccattcccattttactgctcttgctttctctcatatttgcccattcctccatctcctgtgcctgtctgtatcatccactttcagaactcagacactgttattttaagggtactcatagtgtcacatgctaaaaattcttttttctttctcttttttttttttttttttttttgagacagagtctcactctgtcacccaggctggagtgtagtggtgtgaactcggctcactgcaacctccgccttccaggttcaagcgattctcctgcttcagcctcccaagtagctgggattataggctcctgccaccacacccggctttttgtatttttaatagagatggggtttcaccatgttggctaggctggtctcaaactcctgacctcaagtgatcctcctgcctcagcctcccaaaatgttgggattacaagtgtgaaccgctgcgcctggccaaaaatcattttttctgtagt

SEQ ID NO: 204947 - DNA, 601 bp, Human
ctgccaccacacccggctttttgtatttttaatagagatggggtttcaccatgttggctaggctggtctcaaactcctgacctcaagtgatcctcctgcctcagcctcccaaaatgttgggattacaagtgtgaaccgctgcgcctggccaaaaatcattttttctgtagtcacatgctgaaaatcacttattctgtgatcgaccacaacaagttaattttttcaaaaagactcaatttagtctttttatacataaggcaaagtcttagtatacatagtcttagtatacataaggcaaatytgatttcctccttttggtgatcatgtcatgaaggttagaggtctgacaaagagtaagatatatttcatacaaatgatcaagaacatcacatttaaaatatttgagtccttgccactttatgcaaggcatttggagaatcttttgggggaaacattctccgggtaagacagagctgtccccgtgattcactggtgggactgaccatctgatttgcaaataatgaagaaagtgaaaggaggcggctggatgtcagccagcaggctgtgggaaggccagagcccttctgatggggtagggctt

SEQ ID NO: 204948 - DNA, 601 bp, Human
tacacacctacaaattattgaccaagtgattttcaaagaacaattatttgtttttgccctaattaaatggattttaattttttgaggacacttgctatgaatagttcacctccaggtttttcctccatcttgatgaaaatccttcctggccagtttgctaagactgaactgtcttctggaaggccccagcgaacattcactctcctgttctagctcacagtcctgtgttcctttgtgatgtacctcacttagcttctggcagtcttctgaatccagaccactcacttctgaactctagccygaggttacacagcggaagagaggtagagctgttaacggaattccaactcactaggctcttgactgtggccctccgagcccctccatttcacagccggtccttgatggaaaccaggctgaggctgctgtaccaatgatagtctgtccctagtgtcccaaactttggtactttttcaagttcttatttgaaaaaacttgtaacttagagtttggaggacacggaatatattgctaaataggagaataaaactacatttccttaaagaaaactgtagaaggaagggtttctcttagctgaagt

SEQ ID NO: 204949 - DNA, 601 bp, Human
ttgtaacttagagtttggaggacacggaatatattgctaaataggagaataaaactacatttccttaaagaaaactgtagaaggaagggtttctcttagctgaagtgtgactgccaggccctcagcatgattgccttcatttccagcgtccactggggtcatctgagagtccatcccgaagccgaatgtcaccttgtaaagctgtgtgtttgagaagtcacagtcttgtggatgaaacatctttctcctgttagtatttgacatagagtaaaataacaagtaacttcagttttttccttaraggtatatagggcagtagaatgacatcatacttgcacatcaaaagcatgtagtctgtttttgatgcacctggcacgtgacagccagctgtctgccccatgtgtcggttggtgaagagtcaaaacagaccagccactagggtgtctgtcctacaacattaggggctatattagacagggtgggtaattttcttgcaattatatttttttctttttttaactagcaccatttgtgtgtgtgtgtgtgtgtgtgtgtataagactcaaataaaggggaagacttgctatttcatgttatgaaa

SEQ ID NO: 204950 - DNA, 601 bp, Human
atcatttctttttcttttcgcttttcttttctttttttttttttttttttttgagacagagtctctctgtgtcgcccagtctggagtgcagtggcgtgatctcagctcattgcaatctccgcctcctggattcaagcaattctcctgcctcagcctcccaagtagctgggattacaggcgcccaccactacacctgactaatttttgtatttttagtagagatggggtttcaccgtgttggccaggctgatctcaaactcctgacctcaggtgatcctcccgcctcggcctccgaaagtgstaggattataggcatgagccactgtgcccggcccctatattatttgttttacttaactcagttccagacagatacaagatttaaatgttaaaaaaaaaaaaaaaaaaaaagctaacaaaaaactgtatttgcctcaagggtgggatggtgggggcagggctaataggtgctaagtgtactctctactggaatattctttgagattgggtgccatctatttcccattccaaaagtttatttgtaagattaataattaaactattaaattactcaaaggaattatgggagagaaatactttt

SEQ ID NO: 204951 - DNA, 601 bp, Human
tgtgtcgcccagtctggagtgcagtggcgtgatctcagctcattgcaatctccgcctcctggattcaagcaattctcctgcctcagcctcccaagtagctgggattacaggcgcccaccactacacctgactaatttttgtatttttagtagagatggggtttcaccgtgttggccaggctgatctcaaactcctgacctcaggtgatcctcccgcctcggcctccgaaagtggtaggattataggcatgagccactgtgcccggcccctatattatttgttttacttaactcagttccaracagatacaagatttaaatgttaaaaaaaaaaaaaaaaaaaaagctaacaaaaaactgtatttgcctcaagggtgggatggtgggggcagggctaataggtgctaagtgtactctctactggaatattctttgagattgggtgccatctatttcccattccaaaagtttatttgtaagattaataattaaactattaaattactcaaaggaattatgggagagaaatactttttaaaaagaagtatgaaagtccctttctatgtaagacaaaacccctcagcgtgacagttgtcagaatg

SEQ ID NO: 204952 - DNA, 601 bp, Human
tgcaatctccgcctcctggattcaagcaattctcctgcctcagcctcccaagtagctgggattacaggcgcccaccactacacctgactaatttttgtatttttagtagagatggggtttcaccgtgttggccaggctgatctcaaactcctgacctcaggtgatcctcccgcctcggcctccgaaagtggtaggattataggcatgagccactgtgcccggcccctatattatttgttttacttaactcagttccagacagatacaagatttaaatgttaaaaaaaaaaaaaaaaaaaaagctaacaaaaaactgtatttgcctcaagggtgggatggtgggggcagggctaataggtgctaagtgtactctctactggaatattctttgagattgggtgccatctatttcccattccaaaagtttatttgtaagattaataattaaactattaaattactcaaaggaattatgggagagaaatactttttaaaaagaagtatgaaagtccctttctatgtaagacaaaacccctcagcgtgacagttgtcagaatgtgggaatgttattgcattctctttcaaaagcaatttgacaaaa

SEQ ID NO: 204953 - DNA, 601 bp, Human
tacttaactcagttccagacagatacaagatttaaatgttaaaaaaaaaaaaaaaaaaaaagctaacaaaaaactgtatttgcctcaagggtgggatggtgggggcagggctaataggtgctaagtgtactctctactggaatattctttgagattgggtgccatctatttcccattccaaaagtttatttgtaagattaataattaaactattaaattactcaaaggaattatgggagagaaatactttttaaaaagaagtatgaaagtccctttctatgtaagacaaaacccctcagcstgacagttgtcagaatgtgggaatgttattgcattctctttcaaaagcaatttgacaaaatccatcggttctaaatacacagtctccttaagcctagcattttttcttctggaaatttcagagaccttttggattgcagttttcatctaaagaaccaccaggatggctgattaatagaaaggagaggtttataggcagtaacattttacagactgggaagagaccttctctggtgtgtgctgaagatgaagggacacattgggttttatgcctcacagggcctgtatcacactagagtca

SEQ ID NO: 204954 - DNA, 601 bp, Human
tagcattttttcttctggaaatttcagagaccttttggattgcagttttcatctaaagaaccaccaggatggctgattaatagaaaggagaggtttataggcagtaacattttacagactgggaagagaccttctctggtgtgtgctgaagatgaagggacacattgggttttatgcctcacagggcctgtatcacactagagtcacatatatttaggagtttgggggcaaagcgatacgtatgtatgagaggagtcaagagcatgtgcagtaggtaaacatatgtaacatccatccttgwtgactttgaggtgagattttagcattaaaatgaggtggaattgggctctttatgtgaaaaggtgaactgtgggacacagtttgtgcacagcctcagcgagctgctgaaactggctttaaggcctgcagttgcttgtcagaagaaaatgtttctaaggccagtcctctgcccagtcagagttgtcttggtctgggttgtaaatcagagttaggaggggtctgataggtcctgttcttagtgagtttagagccctagtaatttaaaaagttgctctattcccttaaccttaggatccatctt

SEQ ID NO: 204955 - DNA, 601 bp, Human
gagattttagcattaaaatgaggtggaattgggctctttatgtgaaaaggtgaactgtgggacacagtttgtgcacagcctcagcgagctgctgaaactggctttaaggcctgcagttgcttgtcagaagaaaatgtttctaaggccagtcctctgcccagtcagagttgtcttggtctgggttgtaaatcagagttaggaggggtctgataggtcctgttcttagtgagtttagagccctagtaatttaaaaagttgctctattcccttaaccttaggatccatcttagttgataaagcrgtgtctgttttggtctgtccgatcacatggtattatagtacccaaagactgaaaacaagataaatgaacatcagcatatactggtcaagttgtaggaaatatatacaatggaattttatggagacaatgtgaaagaatattgtgtccatatgtgctgatgtaccttgcagaatgttttatgctgttaagagaaaaaaaaaaagtaccgagcaaaaataatacaatttaggccaacttagtgtttaaaaacaaaaaggatctatctctgtccatgggatgtttgagtaagtatatacaagg

SEQ ID NO: 204956 - DNA, 601 bp, Human
cagtcctctgcccagtcagagttgtcttggtctgggttgtaaatcagagttaggaggggtctgataggtcctgttcttagtgagtttagagccctagtaatttaaaaagttgctctattcccttaaccttaggatccatcttagttgataaagcagtgtctgttttggtctgtccgatcacatggtattatagtacccaaagactgaaaacaagataaatgaacatcagcatatactggtcaagttgtaggaaatatatacaatggaattttatggagacaatgtgaaagaatattgtgtycatatgtgctgatgtaccttgcagaatgttttatgctgttaagagaaaaaaaaaaagtaccgagcaaaaataatacaatttaggccaacttagtgtttaaaaacaaaaaggatctatctctgtccatgggatgtttgagtaagtatatacaaggaatttgttagtagcatgaaacaaaaattatagtaggccattgtttcagagttcctgcactaggccccagcagaccaggccaaaccagaatggagttccttgtgctagatgctccatagtcaaactgaaacttgaaggaagcagata

SEQ ID NO: 204957 - DNA, 601 bp, Human
agtgatgtggactgacagccctttaaaaaaattatctatattttcacgcctgtaatcccagcagtttgggaggccgaggcaggcggatcacaaggtcaggagatcaaggccatcctggctaacacggtgaaaccccatctctactaaaaatagaaaaaaaattagccgggtgtggtggcaggcgcctgtagtcccagctactcgggaagctgaggcaggagaatggcctgaacccaggaggcggagcttgcagggagccaagattgcgccactgcactccagcctggccaacaaagcgagrctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcgtgcctgtgggtgtgtgtgtggtaagagcacctaaaatctccctcagcaggtttcccaaatataatgcaatatcattaactgtagtcctcatgctgtacatgagatctctagacttatcctacatgactgcaactttg

SEQ ID NO: 204958 - DNA, 601 bp, Human
actaaaaatagaaaaaaaattagccgggtgtggtggcaggcgcctgtagtcccagctactcgggaagctgaggcaggagaatggcctgaacccaggaggcggagcttgcagggagccaagattgcgccactgcactccagcctggccaacaaagcgaggctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgygcgtgtatatgtgcaagtgcgtgcctgtgggtgtgtgtgtggtaagagcacctaaaatctccctcagcaggtttcccaaatataatgcaatatcattaactgtagtcctcatgctgtacatgagatctctagacttatcctacatgactgcaactttgtacctttgacctgcatctccctagttccccgtctccctgcccctggtaaccacctttctactttctgcttctataagttttttagatttttttaaagacctgttaaaagttccacatgtaaataagatccatgtggtatttt

SEQ ID NO: 204959 - DNA, 601 bp, Human
agccgggtgtggtggcaggcgcctgtagtcccagctactcgggaagctgaggcaggagaatggcctgaacccaggaggcggagcttgcagggagccaagattgcgccactgcactccagcctggccaacaaagcgaggctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcrtgcctgtgggtgtgtgtgtggtaagagcacctaaaatctccctcagcaggtttcccaaatataatgcaatatcattaactgtagtcctcatgctgtacatgagatctctagacttatcctacatgactgcaactttgtacctttgacctgcatctccctagttccccgtctccctgcccctggtaaccacctttctactttctgcttctataagttttttagatttttttaaagacctgttaaaagttccacatgtaaataagatccatgtggtatttttctttgtgtgtgatgttgagt

SEQ ID NO: 204960 - DNA, 601 bp, Human
gggtgtggtggcaggcgcctgtagtcccagctactcgggaagctgaggcaggagaatggcctgaacccaggaggcggagcttgcagggagccaagattgcgccactgcactccagcctggccaacaaagcgaggctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcgtgcstgtgggtgtgtgtgtggtaagagcacctaaaatctccctcagcaggtttcccaaatataatgcaatatcattaactgtagtcctcatgctgtacatgagatctctagacttatcctacatgactgcaactttgtacctttgacctgcatctccctagttccccgtctccctgcccctggtaaccacctttctactttctgcttctataagttttttagatttttttaaagacctgttaaaagttccacatgtaaataagatccatgtggtatttttctttgtgtgtgatgttgagtgcat

SEQ ID NO: 204961 - DNA, 601 bp, Human
caacaaagcgaggctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcgtgcctgtgggtgtgtgtgtggtaagagcacctaaaatctccctcagcaggtttcccaaatataatgcaatatcattaactgtagtcctcatgctgtacatgagatctctagacttatcctacatractgcaactttgtacctttgacctgcatctccctagttccccgtctccctgcccctggtaaccacctttctactttctgcttctataagttttttagatttttttaaagacctgttaaaagttccacatgtaaataagatccatgtggtatttttctttgtgtgtgatgttgagtgcattttcatatacctcttggccattttttggtcttctttggaaaaatgtcaatttgggtcctttgtccattttttaattgagctttttttatttgctattgaattgtgcgagttcattatatgt

SEQ ID NO: 204962 - DNA, 601 bp, Human
tgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcgtgcctgtgggtgtgtgtgtggtaagagcacctaaaatctccctcagcaggtttcccaaatataatgcaatatcattaactgtagtcctcatgctgtacatgagatctctagacttatcctacatgactgcaactttgtacctttgacctgcatctccctagttccccstctccctgcccctggtaaccacctttctactttctgcttctataagttttttagatttttttaaagacctgttaaaagttccacatgtaaataagatccatgtggtatttttctttgtgtgtgatgttgagtgcattttcatatacctcttggccattttttggtcttctttggaaaaatgtcaatttgggtcctttgtccattttttaattgagctttttttatttgctattgaattgtgcgagttcattatatgttttgaatattaacaggttatcagatacatggctcgcaaatatt

SEQ ID NO: 204963 - DNA, 601 bp, Human
ttccacatgtaaataagatccatgtggtatttttctttgtgtgtgatgttgagtgcattttcatatacctcttggccattttttggtcttctttggaaaaatgtcaatttgggtcctttgtccattttttaattgagctttttttatttgctattgaattgtgcgagttcattatatgttttgaatattaacaggttatcagatacatggctcgcaaatattttctcccagcctattgcgggatctggccagcagcccgcaatgcaacggggttctctttgtgttcccaggcggatcggcmcgttgagaaataatagacacacacaagatagcgaaagctgggtccgggggggtcactgccttctggtcctgcagtgccaacaatgcactggatataccagcatttattattaagtttagtgagggcgggggtaggttagtgagggatttagggtcatttgattatgaggtgagatggtcacatggggatgaagtaattctttaacataacatctgtatgcagaagtacagtatacagagataagaatttacaatatagtgtatgcatcagtaatttctgacagagccttaaaacagaaac

SEQ ID NO: 204964 - DNA, 601 bp, Human
tccacatgtaaataagatccatgtggtatttttctttgtgtgtgatgttgagtgcattttcatatacctcttggccattttttggtcttctttggaaaaatgtcaatttgggtcctttgtccattttttaattgagctttttttatttgctattgaattgtgcgagttcattatatgttttgaatattaacaggttatcagatacatggctcgcaaatattttctcccagcctattgcgggatctggccagcagcccgcaatgcaacggggttctctttgtgttcccaggcggatcggccsgttgagaaataatagacacacacaagatagcgaaagctgggtccgggggggtcactgccttctggtcctgcagtgccaacaatgcactggatataccagcatttattattaagtttagtgagggcgggggtaggttagtgagggatttagggtcatttgattatgaggtgagatggtcacatggggatgaagtaattctttaacataacatctgtatgcagaagtacagtatacagagataagaatttacaatatagtgtatgcatcagtaatttctgacagagccttaaaacagaaaca

SEQ ID NO: 204965 - DNA, 601 bp, Human
ttgtttcctttgctgttcagaagctttttagttccatgtagtcccgcctgttatttttgactttgttccctgtgcttttggtgtaatactcaaaaaaacatttgccaaggccagcgccaaggagcttttcccctgtgtttccttctaggagttgtgtggtttcaggtcttccatttaggtctgtaatctattttaagttgatttttgtgtgtggtgtaagacaaggtccagttttattcttttgcatgtagatacctggttttcccagcacgacttactaaagagactgccctttctccaytgtgtcatctcggtgcccgtgtcaaaaatttaaaagtaatctgatagccctctttaagttgcttctgatttgtcttttgcactaaaagaatctgtaattcaaggcttaaaattgactacacagcctttactcttaacatccatattatactcctatactatacccttttctccatcaaaaaaaaattgatttgcccagtaggtagttactgtcagaaaattaagtaatttcatttttattttggtcttttttttttttttaactgatgatcttccattttcacctctagcaactggtgat

SEQ ID NO: 204966 - DNA, 601 bp, Human
ctgttcagaagctttttagttccatgtagtcccgcctgttatttttgactttgttccctgtgcttttggtgtaatactcaaaaaaacatttgccaaggccagcgccaaggagcttttcccctgtgtttccttctaggagttgtgtggtttcaggtcttccatttaggtctgtaatctattttaagttgatttttgtgtgtggtgtaagacaaggtccagttttattcttttgcatgtagatacctggttttcccagcacgacttactaaagagactgccctttctccactgtgtcatctcrgtgcccgtgtcaaaaatttaaaagtaatctgatagccctctttaagttgcttctgatttgtcttttgcactaaaagaatctgtaattcaaggcttaaaattgactacacagcctttactcttaacatccatattatactcctatactatacccttttctccatcaaaaaaaaattgatttgcccagtaggtagttactgtcagaaaattaagtaatttcatttttattttggtcttttttttttttttaactgatgatcttccattttcacctctagcaactggtgatgatgatgactgg

SEQ ID NO: 204967 - DNA, 601 bp, Human
tttcccagcacgacttactaaagagactgccctttctccactgtgtcatctcggtgcccgtgtcaaaaatttaaaagtaatctgatagccctctttaagttgcttctgatttgtcttttgcactaaaagaatctgtaattcaaggcttaaaattgactacacagcctttactcttaacatccatattatactcctatactatacccttttctccatcaaaaaaaaattgatttgcccagtaggtagttactgtcagaaaattaagtaatttcatttttattttggtcttttttttttttttaactgatgatcttccattttcacctctagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaagtaagtttaaaggggagccagggaaccagggccgtggtagaagtatacattaatacaaagtatataccctaccaagaggcagctggccttttccctttccagtgatctcctaagttttggata

SEQ ID NO: 204968 - DNA, 601 bp, Human
gccctcatatccctttgtggtacataaaacccctgttttactgcaggcaaactgatgcccagagagacgcatcgagtgttccagtcaggaagccaggccctcaggcgccaaagcacgtgtttcagctcctgtgcctaaaaacgtggtccggagctttgtgttagcttaggtttctcttagatttaaaacaaaaaaaaaagtgttgtgttttatttttttgttttgagacaggcgtctcgctctgtcacccaggctgaagtgcagtggtgcgatcttggttcactgcaaccccaacgtcccrggttcaagcaattctcgtgcctcagccacctgagtagctgggattacaaacatgtgccaccgcgcccagctaatttttgtatttttagtagagacgaggttttaccacgttggccaggctggtctcaagctcctggtctcaagtgatccgcccgcctctacctcccaaagtgctgggattacaggcttgagccaccacacctagccaaaaaaaaaaagtttttaacagtacttgtagataccctacttaacaggaaagcatgtgggcaccagtgaccactgtaggattctttggagagac

SEQ ID NO: 204969 - DNA, 601 bp, Human
tctgaaattaaatatacttgagcactataagaattcaccttgggccaggtgcagtgcctcatgtctgtaatcctagcactttgggaggccgaggcaggcagatcacgaggtcaggaattcgagaccagcctggccaacatggtgaaacctcaatctgtaccaaaaatataaaaaagtagctgggcgtggtggcacgcctgtaatcctagctacttggaaggctcaggcaggagaatcgcttgaacccgggagacggaggttgcagtgagccgagatggcaccactgcactccagcttgggygacacagagactctgtctccaaaaaaaaaataaaaggcatcttgatgatgctgaaataattaatacattgctgtcctcaaatttttctgtggtccataacagtgcccaaaaattgaaatgcttacaagctggtcaaggagttgtcatgatatataatccccacagaagcgcacctgtagtcccagctacttgggagactgaggcaggataatcgcttgaaccaggaggtggaggttacagtgagccgagatcgcgccactgtactccagcctggcgacagagtgagactctgtctcaaaa

SEQ ID NO: 204970 - DNA, 601 bp, Human
ctaaaagaaaaattctaaaacccaaattaatcttgtctttttcagtagccctttggatggctatgttctagctgtcctctaatttcagaaatgtcctttggatatagatgtgatttctggaagtagtcaagtttatttaagtttttgagtcttaagtgacctcccccccaccccctccccatagccaaatttattgattacactttgggtctctactaaagagacttgttttccgctgtcatgaactgcttctgaaggcaattccaaaagaaacaagcacatatgctgatgagcaggacakcccctttgggacagttgtggcctctggagagagcctgttgaaaggcaactttaatttggatgtagaaatgccagcatgtggctattgccccctgtggccaactcagattggcgtgctcactactcactgccccagggaactaggggggcgttttttcaggtctgcccttcactctggggtgaccgaatgtttcagacacagtcaagcaaatagagtgcccgtaaacatcacaccttctggagtcaaactgttctgtttaccagatcaagcttaattaaatgcctaattggccattgaaca

SEQ ID NO: 204971 - DNA, 601 bp, Human
tcaagcttaattaaatgcctaattggccattgaacaatctgattacattaggtttcatttaccacagtttccagttctagtgcacccgaaagacaggacaaggttaaaactggtaagtaaatgtagacgagagttgtaaaattcttacaaggaaagtcttaagactgatgaacatttatattcatgattagatttcctggatttgcgaaacctggcacggaacagtatttgttggccaaacaactagcaaaacccaaagagaaaattcccatcattgtaagtttgtttatttttgtttgcyttctttctgattaagctctttcttataccgtactttaaagctaagcgagttattcatcttttggaaagtatttttaaatatatttaatgccccacataactgataatatatgttagtgttgtaggagtactgaagataattaacacaaattaatgcctgtcattatattgtttattctttatctttcagacttttagtattgaacaaatatactattttgatcatttttttctaaagtgtcttgaagtgtattttacatagtttttctgccagccctatatgtttaactgatgaactcaa

SEQ ID NO: 204972 - DNA, 601 bp, Human
ccaaagagaaaattcccatcattgtaagtttgtttatttttgtttgctttctttctgattaagctctttcttataccgtactttaaagctaagcgagttattcatcttttggaaagtatttttaaatatatttaatgccccacataactgataatatatgttagtgttgtaggagtactgaagataattaacacaaattaatgcctgtcattatattgtttattctttatctttcagacttttagtattgaacaaatatactattttgatcatttttttctaaagtgtcttgaagtgtatyttacatagtttttctgccagccctatatgtttaactgatgaactcaattcaaatatttatgtttcttcccttgtaaagtacatgtatgttatcagaataaggtaccctttcagatatatgggtaatagtgtttttggtaatagtgttttttccagtaaaccagctgtcaaattgagataaggagctaccaaatggaagctgggagttaaagacatcattgagaatatctgtcttagaattacttggttattgcataatgtgacacaagcccttcggtttcattccacattttgattggtg

SEQ ID NO: 204973 - DNA, 601 bp, Human
cctctgcctcccgggttcaagcaattctcctgcctcagcctcccgagtagctgggattacaggcatgcaccaccacgcctagctaattttttttgtattttatagtagagacggggtttcaccatattggccaggctggtcttgaactcctgaccttgtgatccgcccacattggcctcccaaagtgctgggattacaggtatgagccactgcgcccggcctgcctcacattcttaaaggggactttgtcccaggtttgcagtggtggtacagagctaagggttccagcctttcattgacyggcaagttttaagtagaactgcacccatgcacccagtaggcaggtctgcctgtgtgggcgtctatacatggaagaagctgaggaaagccaccgcgtcttcaggaggcccagagaaagcagagactaactctttgctctaaaagtgcagtaaccttgcccactcatgaaacagagccccgtgaaattgggccttagccaagcacagttgctgctctcggcccactcactgagggaggtcccgaaagtcatctcctctgcagctttcagctagtttcttggatctgggctctccctgagggg

SEQ ID NO: 204974 - DNA, 601 bp, Human
attacaggtatgagccactgcgcccggcctgcctcacattcttaaaggggactttgtcccaggtttgcagtggtggtacagagctaagggttccagcctttcattgaccggcaagttttaagtagaactgcacccatgcacccagtaggcaggtctgcctgtgtgggcgtctatacatggaagaagctgaggaaagccaccgcgtcttcaggaggcccagagaaagcagagactaactctttgctctaaaagtgcagtaaccttgcccactcatgaaacagagccccgtgaaattgggccytagccaagcacagttgctgctctcggcccactcactgagggaggtcccgaaagtcatctcctctgcagctttcagctagtttcttggatctgggctctccctgagggggttatagtaattgttctcagagattttagtctctttttaaactactcttatccttggagtaggtcaccttcctgacctaacagcctctgaactttaatatcccaatccgcttttcccatcttcctcttaaaaaaaaaaattaggactgggtatacctttttttcctttttatgtctgtctggccttgcctct

SEQ ID NO: 204975 - DNA, 601 bp, Human
tgctgctctcggcccactcactgagggaggtcccgaaagtcatctcctctgcagctttcagctagtttcttggatctgggctctccctgagggggttatagtaattgttctcagagattttagtctctttttaaactactcttatccttggagtaggtcaccttcctgacctaacagcctctgaactttaatatcccaatccgcttttcccatcttcctcttaaaaaaaaaaattaggactgggtatacctttttttcctttttatgtctgtctggccttgcctctctgaggtctcagccraaacaaatctctcttccttcagcgcaatctgtgtgatttttctcattttctttttactttcttatggtactttttcaagtctgcaagaataaaacctgttccataaattatttcattctccttgaatctctgaatgaatctctgagtgaatctgcttcctgaatagtggtccttttacagtccatgtgtttgttttttcattctcttcttggattataactcaattatttttcattttcaagccaagaagatagataacattctcagtataataaggacttctattgctctgaaatgtgt

SEQ ID NO: 204976 - DNA, 601 bp, Human
cattttctttttactttcttatggtactttttcaagtctgcaagaataaaacctgttccataaattatttcattctccttgaatctctgaatgaatctctgagtgaatctgcttcctgaatagtggtccttttacagtccatgtgtttgttttttcattctcttcttggattataactcaattatttttcattttcaagccaagaagatagataacattctcagtataataaggacttctattgctctgaaatgtgttttgataagagctactgtcctgcagtctgaacctctagaatctrtcattgtgatcaaagtttatgaaatgaatgaggcagaaccaacttgagactattggtgactcaggtagtgattccagaagcctgtacatgagctccagcatccaggttcctctgcagctgcccccatggccttggatgctgttttaaataagatgaaaaaaccaggtttgggacagcagacctattgtcacctagcagtgcctagaagaaatgatcctcaggctcaaaacttacacgaggtctctacacccccacatagaatttagctggtttcccttcctcacctcccaccacaactaa

SEQ ID NO: 204977 - DNA, 601 bp, Human
ctgttccataaattatttcattctccttgaatctctgaatgaatctctgagtgaatctgcttcctgaatagtggtccttttacagtccatgtgtttgttttttcattctcttcttggattataactcaattatttttcattttcaagccaagaagatagataacattctcagtataataaggacttctattgctctgaaatgtgttttgataagagctactgtcctgcagtctgaacctctagaatctgtcattgtgatcaaagtttatgaaatgaatgaggcagaaccaacttgagactrttggtgactcaggtagtgattccagaagcctgtacatgagctccagcatccaggttcctctgcagctgcccccatggccttggatgctgttttaaataagatgaaaaaaccaggtttgggacagcagacctattgtcacctagcagtgcctagaagaaatgatcctcaggctcaaaacttacacgaggtctctacacccccacatagaatttagctggtttcccttcctcacctcccaccacaactaaaaccccagtgagctagtgtaagcctcgcctgaatttgtgaacttttgcccta

SEQ ID NO: 204978 - DNA, 601 bp, Human
ccccagtgagctagtgtaagcctcgcctgaatttgtgaacttttgccctagtcacagatagaagagaaggccagtgagaaaagaatggaggcctaccctcttcaggcaagccttgcccaggtggacgtgatacccgggggttggaagtgagccagcccactgtgcttaggcacatagcagtccacggaagaaaacagctagcctggttcttgcttttaagatgtagtacctccccctccccccaccttgccactagtagtaaaacaatgactatcaggctctggccaatctgattaatcgyttctatgagccagaacaatgctactcaaagtatggtccacagaccacttgcccatctgaaaactgcttgttcctgatccaccgtgagataggtacagtacatgagaatattttgaaaacttgaggacaatttggtattgttgaaaaatcaaaatgtgtaatgttatatttcaccaaactattagtctgtgatagattcgaaatttttaaaaactagtccttcatcacgtgtagcttgagacagctagactagaaagaaacattgtcttgtaaccagcactgtccttgggagagggaagct

SEQ ID NO: 204979 - DNA, 601 bp, Human
agtatggtccacagaccacttgcccatctgaaaactgcttgttcctgatccaccgtgagataggtacagtacatgagaatattttgaaaacttgaggacaatttggtattgttgaaaaatcaaaatgtgtaatgttatatttcaccaaactattagtctgtgatagattcgaaatttttaaaaactagtccttcatcacgtgtagcttgagacagctagactagaaagaaacattgtcttgtaaccagcactgtccttgggagagggaagctggtgtctcctctccatgggctgagctacycacgtgggagcagaagggtttcccacaggtgtgttctttaaacataatatctaacaggaacagaaaccattgaaccatttatgtacctttcaaagaggaacaagaatgaccctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccaggaaaggctccaaaa

SEQ ID NO: 204980 - DNA, 601 bp, Human
tgggctgagctactcacgtgggagcagaagggtttcccacaggtgtgttctttaaacataatatctaacaggaacagaaaccattgaaccatttatgtacctttcaaagaggaacaagaatgaccctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccagraaaggctccaaaatgtatggtctaaagagctacatcgaatatcagctaacacctactgtaagtatccacgttatcaaaagcagaatcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgt

SEQ ID NO: 204981 - DNA, 601 bp, Human
atcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgtgtgtaatgctaaacccaggatgacaaatagaaagactccagtcagattatcttcctgtaagtcagtgatggcattttccatcctrtagagcagcaggatgcaggagttggaaacagtaattaaatacagctatgaagagagaaccattgcatgttgtacatctatctggaagttgcctaaacgtctcacaagaacgtttaatgtgcaaatcacaggttttggtatgtgtctggaattccagcagtcattgtcttcattgctgtaccttttctacaaaagaaatgtgtacatttaaaatatgtgaaaaatgacacctgaaaaaatagaaataattcaaatagcctaaaatggaaataaaaatgtatgacccacatgatgcaaacag

SEQ ID NO: 204982 - DNA, 601 bp, Human
ttctcttccagacaaacaagtcacaggtgagtgtgtgtaatgctaaacccaggatgacaaatagaaagactccagtcagattatcttcctgtaagtcagtgatggcattttccatcctgtagagcagcaggatgcaggagttggaaacagtaattaaatacagctatgaagagagaaccattgcatgttgtacatctatctggaagttgcctaaacgtctcacaagaacgtttaatgtgcaaatcacaggttttggtatgtgtctggaattccagcagtcattgtcttcattgctgtaccytttctacaaaagaaatgtgtacatttaaaatatgtgaaaaatgacacctgaaaaaatagaaataattcaaatagcctaaaatggaaataaaaatgtatgacccacatgatgcaaacaggttatgcagatgagctgcattatttcattagatgagtgagcactggacagagaagccacagaactactaagtgttaatgaaggaagaagctgccaggttttctacttattttgattattaccctctcccttttcttgttttttaaaagtgccattttctatttattttgattattaccctct

SEQ ID NO: 204983 - DNA, 601 bp, Human
attctccttaaaacattactttatattttactttgttttatgtttatttttccctgaagtgttttgtggagatggaaacttttgttttaaaagaagttttgattttgatttttttggaacacatttcaaaaatttcaaattgtcatagcaaaattgaaaatggggctgcactactgggtagataaacacatctccccagtcccctgggtgacacttgagtggtccctcgtggtgctggggcggtggagtgacagccagatggccgtgggctgctgctgccttctgcccagaggcactgacygaacccctgcttctaacccagttcagacactccctgtacctcaacccggttcagacactccctgtacctcctttttgtcatccttattgctttcaatcacagttttctcttaaaaaatacagatttctttccatgaaaacttcagttctgccatataaaattatagtctatttccttgaattttgtgctctcctttatcaacttggttagcacagtgtgtgctccacagtgtttaaatccatggcttaatggcctatttcaggcttgtaagaaattctcatatcttttagattttaatac

SEQ ID NO: 204984 - DNA, 601 bp, Human
tttccctgaagtgttttgtggagatggaaacttttgttttaaaagaagttttgattttgatttttttggaacacatttcaaaaatttcaaattgtcatagcaaaattgaaaatggggctgcactactgggtagataaacacatctccccagtcccctgggtgacacttgagtggtccctcgtggtgctggggcggtggagtgacagccagatggccgtgggctgctgctgccttctgcccagaggcactgaccgaacccctgcttctaacccagttcagacactccctgtacctcaacccrgttcagacactccctgtacctcctttttgtcatccttattgctttcaatcacagttttctcttaaaaaatacagatttctttccatgaaaacttcagttctgccatataaaattatagtctatttccttgaattttgtgctctcctttatcaacttggttagcacagtgtgtgctccacagtgtttaaatccatggcttaatggcctatttcaggcttgtaagaaattctcatatcttttagattttaatacattgtttattctgaatcagataattcagtgctcttttaaagcttcaga

SEQ ID NO: 204985 - DNA, 601 bp, Human
attttaatacattgtttattctgaatcagataattcagtgctcttttaaagcttcagagagtcacggttctccttccatactaagatttgtttaaaaaaaaataagttcggcatgcagccagggaggagaaagtcatagaaaagcaagaaagcagcagcccctcggtgtgaagaaagttgagctttgattcactaactgggatatgagccaaggaagccgaacagcacagaagggctctatttccccctcacttgtgtgcctcctgcctgggatgcccacagatcattattatgtaagaaytcccctctcgctcaactactggagaaaagaaaaaggaatgcttagtaggtgatgctatgacattcctgtggactcgataattcatgaaaaaatgtacagttaacatttctttatttgtttagagatttttgttttttatggaaataatattgaatgaatatagttttattcctggtaccaaactgacatattcatatacttagtgaaaaccttagtaaggttcatggaaaacagggaaataaaagttcctctttttttctaattatttgcaacttggtctgaaaattctaccaagcataa

SEQ ID NO: 204986 - DNA, 601 bp, Human
aataatttttgaataaaataaggatcactaaatttcaaccaatgataggataatgaactctgggtacaactcacctagccataatggggagttcatcgtatcccaggtccagactggctttccggccaggaggtgaattgtcttttttccaaggcacaaggctttgtttctgcttaatctactgctagtaaatgcaaagtttgcaatgctttagtacaatgatggtgtctagactcattgttctgttcaagtccactttttaggtaataaaagttttttgatatgtaggtgcataatactrtctatctatattttatttatttatttatttatttatttttggagacggtctcactctgccacccagcctggagtgcagtggcacaatcatagctcactgcagccttgacctcttggactcaagtgatcctcccacgtagctgggattataggtgcacgccaccattgcctggcttatactcataatttctaaaggaaagttcaggtttcattttttaaattttatttttaaacttaggtacagtaaattcactctttttggtgtacagttctgagttttgacagctaccactgcagtcct

SEQ ID NO: 204987 - DNA, 601 bp, Human
caaccaatgataggataatgaactctgggtacaactcacctagccataatggggagttcatcgtatcccaggtccagactggctttccggccaggaggtgaattgtcttttttccaaggcacaaggctttgtttctgcttaatctactgctagtaaatgcaaagtttgcaatgctttagtacaatgatggtgtctagactcattgttctgttcaagtccactttttaggtaataaaagttttttgatatgtaggtgcataatactatctatctatattttatttatttatttatttatttatttttggagacggtctcactctgccacccagcctggagtgcagtggcacaatcatagctcactgcagccttgacctcttggactcaagtgatcctcccacgtagctgggattataggtgcacgccaccattgcctggcttatactcataatttctaaaggaaagttcaggtttcattttttaaattttatttttaaacttaggtacagtaaattcactctttttggtgtacagttctgagttttgacagctaccactgcagtcctgcaaccaccactacatttcatgatacagaacagct

SEQ ID NO: 204988 - DNA, 601 bp, Human
ccccctggtcctaaccatggcaacagctgatgtgttctttgtgttcataattctgcgttttctaggatgtcattataaatggaagcatgcagtgtatagtctttcgagtctgactgctttcatttagcataacacatttgcaattcaatcattttgttgtgtcaatagtttgttcttttcgtggccaatagtattccagtgtttagatataccatagcttgtttatccattcactcattgaaagacatttgggtttccagcttttggcaattatgaataaagctgccgtaaacatttgcatacaggtttttgtatgaatgtaagttttcattcctcttgggtaaataagagtaaaatgactgggtcatttggcaagtatatatttaatgtttaagaaattgcccaactgtttttcaaagaagctataccattttggaatcctcaccagcaatatatgagagtatcagtagtagttccacatccctacctgcacttgatagtgtcagtttttcctcattttaaccagtccgataggtatgcagtggtatctcagcatggttttgatttgcatttcctgatggcgagtggggttgagcatctc

SEQ ID NO: 204989 - DNA, 601 bp, Human
attttgttgtgtcaatagtttgttcttttcgtggccaatagtattccagtgtttagatataccatagcttgtttatccattcactcattgaaagacatttgggtttccagcttttggcaattatgaataaagctgccgtaaacatttgcatacaggtttttgtatgaatgtaagttttcattcctcttgggtaaataagagtaaaatgactgggtcatttggcaagtatatatttaatgtttaagaaattgcccaactgtttttcaaagaagctataccattttggaatcctcaccagcartatatgagagtatcagtagtagttccacatccctacctgcacttgatagtgtcagtttttcctcattttaaccagtccgataggtatgcagtggtatctcagcatggttttgatttgcatttcctgatggcgagtggggttgagcatctcttcatgtgcttatttcccatctgtagatctttggtgctgaagcttctgttcagctcttgtgctcattttttatcagtctgttttcttattgttgaatcctgagatttttaaaatatatatatgtattttctagaaacaagttctttgtta

SEQ ID NO: 204990 - DNA, 601 bp, Human
ataagagtaaaatgactgggtcatttggcaagtatatatttaatgtttaagaaattgcccaactgtttttcaaagaagctataccattttggaatcctcaccagcaatatatgagagtatcagtagtagttccacatccctacctgcacttgatagtgtcagtttttcctcattttaaccagtccgataggtatgcagtggtatctcagcatggttttgatttgcatttcctgatggcgagtggggttgagcatctcttcatgtgcttatttcccatctgtagatctttggtgctgaagcktctgttcagctcttgtgctcattttttatcagtctgttttcttattgttgaatcctgagatttttaaaatatatatatgtattttctagaaacaagttctttgttagataagtgatttgcaaataacttgtcgcagctgtggcttggcttgtcattttctttttctttttttttttttttttttttttggagacagggtctcactgtcgtcgcccaggctggagtgcagtggcaccatctcagctcactacaaccttgacctcccgggctcaagcagtcttccagcctcagcctcctgag

SEQ ID NO: 204991 - DNA, 601 bp, Human
agctcaagcggtccacccacttcggcctcccaaagtgttgggattagaggcatgagctaccacactagccttgttactttcttaacagtgtcttttgcataacaaaggcttttaattttaatgaagttcactatatcagttttttctttcatggactgtgcttgaggtgtcatggctaagagcagttcacaacattttcttctaaaggttttaggcttttcgtttagatctttgatgcattttgaggttatttttgtataaggtgtgcagtgtggtagaagtagtgcatttttttttcacrtcgggatatccagtgggtctcacaccatcttttggaaagacagatctgttttccatttattagaaacatgtttgtaagagaaaaaaaatcagttgattgtatttgttggtttatttctggattctattctgctccattgatttatgtgtccatccttttcgctagtcctacactgtcttgacttgtgtagctttatggtaagtctttaaatcaagtagcgtgaatcctccaacttggttcctttacaaaattgttttggctattctttttcttttgcctttcctagtaaatttaaatgtc

SEQ ID NO: 204992 - DNA, 601 bp, Human
gaggtgtcatggctaagagcagttcacaacattttcttctaaaggttttaggcttttcgtttagatctttgatgcattttgaggttatttttgtataaggtgtgcagtgtggtagaagtagtgcatttttttttcacatcgggatatccagtgggtctcacaccatcttttggaaagacagatctgttttccatttattagaaacatgtttgtaagagaaaaaaaatcagttgattgtatttgttggtttatttctggattctattctgctccattgatttatgtgtccatccttttcgcyagtcctacactgtcttgacttgtgtagctttatggtaagtctttaaatcaagtagcgtgaatcctccaacttggttcctttacaaaattgttttggctattctttttcttttgcctttcctagtaaatttaaatgtcagtttgtagatatttataatcatgctggaatttttattgaaaccgcattgattctgtagatcaattttcacatcttgatatctcatcttttaatccatatataaaaatatatcgtatttgattttcattagggttttgtagtcttcaacatacagattctgca

SEQ ID NO: 204993 - DNA, 601 bp, Human
attttcgtgcctcagcctcccgagtagctgggactacaggcacccgccaccacgccctgctaattttttatatttttagtagagatggggtttcactgtgttagccaggatggtctcgatctcctgacctcatgattcacccgcctcggcctcccaaagtgctgggattacaggcgtgagccaccgtgcccggccctcttttcttttttaatgtagacaatcatgtcagcttggaatagagagttttatttcatcttttccaatccatgggccttctacttctgtttctgccttattgcasttgctaggacttcctgtatgctcttgagtagaaatagtgagagcaatcatctttggcttattcctgatcttagggacaaagcattcagtctttcaccattaactatgatgttagctgtaggttttttgttagatgtgcttttatcaagttaaggaatttctcttctatttctaggttgttgaaagtttttgttcatgaatagatgctggattttgtcccatgtattttgtgtactcatcgagtgattgtatggcttttcttctgctattaatacagcaaatcacactgatcagctttcca

SEQ ID NO: 204994 - DNA, 601 bp, Human
ggttgaggatttggttcacgatggttattggtctatagttttcttgtaatttgtttggttttagtatcagggcaatgctagtctcataggatgagtttggaactattccctccttgtttatattctggaagagattatatagaattgatactgttctataagtgtttgatagaactcaccactgaaatcatctggacctggagtgttctttgtggggaggctttaactatgaatttaatttccttcatagctataggactattcaggctgagctttggtagcttgggtctttaagggagtygatttatttcatagaagttgttaggtatagttttagagttgctcatagtatttctttgtacctttaaagatgttaggtctactccttcatttctgattttgatcattgtcacctctctttttttctttggttttatgtatttttatttttctcttttctattatattgtttctgctcttttatcatttctatcgcttggtttgggtttgatttattctttttctagtttcttaaatatagaaacttagattattgttttgagatatttccgctatcacaggcattaaatgctaaaaactt

SEQ ID NO: 204995 - DNA, 601 bp, Human
ccttgccaattttctttctagttctatcaattattgagtatcgggtattgaaatttaacattatgattagtggactatctctccttttaattctgtcactttgttttatgtattttgagtctctcttgttaggtagacatacagtttgtaattttaatatcttcctgatgtagtgacctcttatatcatgaggtgtcccccattgtctctagtaagatttcctgtgttaaagtgtacttgtctaatattaatatagccactccatttctgttatggttactgtttgtatggtatatctttycccatccgtttactttcagtatatgtgtgcctttgaaatcaagctgtttctcttataggcaagatagttggatcttacttttttatcaagtctgacaatctctgcttttgattggggtttttaggccatttgtatttaatataattattgacatggttagattcacatttgccattttgttatttgttttctgtgtttgcttctttttcctcctttactgccttttctttgtgttaaatattttacggtgtattgttttaattcctctcattgtttaagctaaatttttgaagttatttt

SEQ ID NO: 204996 - DNA, 601 bp, Human
atcaattattgagtatcgggtattgaaatttaacattatgattagtggactatctctccttttaattctgtcactttgttttatgtattttgagtctctcttgttaggtagacatacagtttgtaattttaatatcttcctgatgtagtgacctcttatatcatgaggtgtcccccattgtctctagtaagatttcctgtgttaaagtgtacttgtctaatattaatatagccactccatttctgttatggttactgtttgtatggtatatcttttcccatccgtttactttcagtatatrtgtgcctttgaaatcaagctgtttctcttataggcaagatagttggatcttacttttttatcaagtctgacaatctctgcttttgattggggtttttaggccatttgtatttaatataattattgacatggttagattcacatttgccattttgttatttgttttctgtgtttgcttctttttcctcctttactgccttttctttgtgttaaatattttacggtgtattgttttaattcctctcattgtttaagctaaatttttgaagttattttcatagtggttgccctaagggatata

SEQ ID NO: 204997 - DNA, 601 bp, Human
tccctcatttatgccattatttttatatatattacatctgtatgttatgaatccaacaatacattgtggtaattactgctttctacagtcttttgtcttttaaagacactaaggaaacaaattagaaaaaaatatatctatagaatcttttacattaatccttatatttccggtgctgcttatttgtctctgcagattcaagtcaccatctttagtaatttctttttagcctgaaggacttcctttaatacttcttataatgcaggtctgttatcagtgaattatctcattatttatctgsgtatgtctttatttttagaggatagtcgtaccgatctggctccattgtgtcagaaagcaagtcagctgttaatgctgtttatctcacgtgcccactctactatgcatgatcagtcattcagatattttttgtctcactctctcttcttcctctgggattctcattacaagtgtttggtgtgcttgatgtattctaatattttacgtttaagttttttttctctgtgttcttcatgttagttaacttctgttgatctatcttcaaattcactaggtgttttttttcttctgctaccttaaa

SEQ ID NO: 204998 - DNA, 601 bp, Human
aattactatactttcaactccagaatttccatgtgattcttttttggtaacttctctctcctttttgaaactctgtgtgttgattctctgtcatatttttctttaattttttaggcttcctttagttctttgaaaatccttatagaatctgctttatctgccacattgtttttttctgccaaattcaacatctgcggacactcagagatagtgtctattgactgtttgtttttttctcagtatggttcatatcttgctatttctttgcgtatctcttaattttttgttgaaaactggacayttttgagaatatattttagcaactccagattctgagtttacctctctgaaggttgttgtttctgctttttatttgttaagtaacttgcctaagattaaatctctgaagtctgtctccctggaagttcagttattgctgtttgtttgtttgtttgtttgtttgttttatatttgtcttcctagagtttgctcctgtgtctgtggattggtagtaagcctttgattgactgacagaggttgtacccaaccacctcaggccagtaagttggggctcctgtcctctgtcaatgtaactgtaact

SEQ ID NO: 204999 - DNA, 601 bp, Human
agtaatttaaaatacctggaggaaaaaagctatagccttgggttactcttcataatgctaaatttaaacttgtatagatgtaatttatattgcatttggacacattttgataatatggaaataccatgtcgtttgtaagaatgacattaaattccactcatcactcctttcttgcttataggacttcatgtggccacacagaaactggcctgttagcttataggaaagagacaggttttcatgttgagataagatttaatttttttttagtactttaaggatacttgaagaaagtagcacyttgaggttgtcattattcttgtcacaatatgtgaatatgttaaattggaattatgttcttaaaaactgaagtctgttgcatcttacctgtgggcctttgagcattcgttgtgttgcttgttttttagattagttaaaaatctccatggtttaccttttgctaaatagctttctacccaatagccagtagacatagaaatggtttttcagttacagtatggtaacagtcattcattttagacaaagttgtatgtcattcttggtgtgtcgcttgcaggccgctttgaagaggaatttatca

SEQ ID NO: 205000 - DNA, 601 bp, Human
aggaaagggagaggcagacatgagccgctcttctcagagccaggccattttcatcactgtaatggtgagtccagagtcagtgctggcctctctctctgcctgcccctgtggcctgtagtctgccagtggtcatctgttcttcattaaaatcaaggaaacgttggctgcctgacatctcaaaagtgtctgctttggaaatagttttctctctcagtaagcatttactgtactccttattgtatcattttattctctaaagatgtttcctccacaatttctctcaacaaatactgcatctctyagcaccctaaagaataaaagcaggagttggcccagaagccacagcagatgctaaatacattatcagcctgggaaataaattatgaagctatttttgtctttaatgaaataatagaatatcatataccctcttggaacttcgagaggtttacttgctaaacttctttgtagtaattttcacttgttgaagtgaacacatagtaagtcttaaatattagggctctatcggtgtatgtttacaggtgtatgcatacacttaacatacatatttgggccttattttcagttattgactatttct

SEQ ID NO: 205001 - DNA, 601 bp, Human
acttggagtcagggcccttgagttctggtcttagtgccacttctagctgcctctgtggtcttagtgaaggtatttaatccctttgggccagaatttcctcacttgctaaatgacactgtagaactacatagaaactatgattctgtggtaagtagcagctcgtgtaaataaatggtagacacagaaacccccaaagaatctgcagagacattattagaaataagtggttagtaaggtagctggatacaagacattgcatatttatcagcaaaaacagaaattgaaaatctaaaaaaaaaawaacctgtcatttacagtaacatcaaaagtatcaaatatccaggaataaatacaagaaaatgtacaaaagatctacatagaaaactatgaaacattattgagaaaaataatagaagacctaaataaattttctaatactgcgtctcatggactggaaacaataaagatgtcatatgtagaaaatcaaaatgccaagcatagccaggatgctcttggaaaataatgaaataggaggaggactttattgcgtatcagaactcattgtgaagctaaaaaagtttaaaagcatggcattggcata

SEQ ID NO: 205002 - DNA, 601 bp, Human
ttggagtcagggcccttgagttctggtcttagtgccacttctagctgcctctgtggtcttagtgaaggtatttaatccctttgggccagaatttcctcacttgctaaatgacactgtagaactacatagaaactatgattctgtggtaagtagcagctcgtgtaaataaatggtagacacagaaacccccaaagaatctgcagagacattattagaaataagtggttagtaaggtagctggatacaagacattgcatatttatcagcaaaaacagaaattgaaaatctaaaaaaaaaataacctgtcatttacagtaacatcaaaagtatcaaatatccaggaataaatacaagaaaatgtacaaaagatctacatagaaaactatgaaacattattgagaaaaataatagaagacctaaataaattttctaatactgcgtctcatggactggaaacaataaagatgtcatatgtagaaaatcaaaatgccaagcatagccaggatgctcttggaaaataatgaaataggaggaggactttattgcgtatcagaactcattgtgaagctaaaaaagtttaaaagcatggcattggcataag

SEQ ID NO: 205003 - DNA, 601 bp, Human
aaagatctacatagaaaactatgaaacattattgagaaaaataatagaagacctaaataaattttctaatactgcgtctcatggactggaaacaataaagatgtcatatgtagaaaatcaaaatgccaagcatagccaggatgctcttggaaaataatgaaataggaggaggactttattgcgtatcagaactcattgtgaagctaaaaaagtttaaaagcatggcattggcataaggctagacaaaccaaccagtagagcagagtagacacttgatctatgacaaagatggcactgggcrtagtaggcaaaggatagtcttttcagtaattggtgctgggtcagttggatggcaaaatgcagggaaatgaaatgtgctcgctacctcactacaatctgcagttgattttattaaggttgttattgatattgttatgtttttaaaacatgtcccaggctgggtgtggcggatcacttgaggtcaagagttcgagaccagccaggccaatatggcgaaaccctgtctctactaaaaatacaaaaattcgccaggtgtggtggcacacacctgtaatcccagctacttgggaggctgaagcag

SEQ ID NO: 205004 - DNA, 601 bp, Human
aaccaaccagtagagcagagtagacacttgatctatgacaaagatggcactgggcgtagtaggcaaaggatagtcttttcagtaattggtgctgggtcagttggatggcaaaatgcagggaaatgaaatgtgctcgctacctcactacaatctgcagttgattttattaaggttgttattgatattgttatgtttttaaaacatgtcccaggctgggtgtggcggatcacttgaggtcaagagttcgagaccagccaggccaatatggcgaaaccctgtctctactaaaaatacaaaaatkcgccaggtgtggtggcacacacctgtaatcccagctacttgggaggctgaagcaggagaatcgttggaacccgggggtaaaggttgcagtgagccaagatcatgccactgcactccagcctgggcaacagagcaaaactctgtctcaaatatatataaatatatatatgtatgtattatatttcaaattagctttaaagtaagaaaaaaaaaatcccagaggtaaaatggaggagaatacctatgaaacaagattggcacctcccggggagcagtggtgcctgggcagcttttcccttgg

SEQ ID NO: 205005 - DNA, 601 bp, Human
aaagatttaaccagttagctcagtgaaagttaaagttttcccagaatatggaggcagcaaagtagttctagacaaaggtcatttcttatttagaggtggtgccattcttggaaagtgtgtaagccgaagtaaatccctactgaaatggcatcacatgccaccacagttccgaaagccttcatcatgtaaatgacttccgtatctcttttactaaactaatgatatttttaaaaagattggcaaaagtgttggtaattatcgaagctgaacctggggggtttattatacttttcttcttttrtatatgtttgaaagttttcattgtatatggtcttcttgaaaatgaattccatgtggctcgcagatttaaatgtgaaaagcaacatagtaatgcttacagaagataacgtggaacatcctcctatcctagagagcagggaagaatttctgaaatatgacatgaaaaagactatgcaggaagatgtggataaattagactacattagaacttcttttttcagccatgacaagcgaaaaacaagctactgagtagaagatacttgcaacatatataagcaatgaagggctagattttagaata

SEQ ID NO: 205006 - DNA, 601 bp, Human
aaagcaacatagtaatgcttacagaagataacgtggaacatcctcctatcctagagagcagggaagaatttctgaaatatgacatgaaaaagactatgcaggaagatgtggataaattagactacattagaacttcttttttcagccatgacaagcgaaaaacaagctactgagtagaagatacttgcaacatatataagcaatgaagggctagattttagaatataggaaaacatcagtaagcccagtggaaaaataggagatgtgatcatgtacttcataaaataaggtatctgaatcracaacagatgtgtagaaaagtacctaatctcattagcaatcaataaatacacattaaaaccacaataagatgccactacacacgtgccagaatggctaaaactgaccataccaagtgtcatcttggtgaggtgagatgctgctgggattcataacgtgttgggggaaaatggtaagactaatttggaaaagtttggcatttactgaagttgaaccctctcatatgacctggcatttccactcctggatatgtactgaatagaaatgcaggcacacagacaccaggagacatctacataac

SEQ ID NO: 205007 - DNA, 601 bp, Human
tctgaaatatgacatgaaaaagactatgcaggaagatgtggataaattagactacattagaacttcttttttcagccatgacaagcgaaaaacaagctactgagtagaagatacttgcaacatatataagcaatgaagggctagattttagaatataggaaaacatcagtaagcccagtggaaaaataggagatgtgatcatgtacttcataaaataaggtatctgaatcaacaacagatgtgtagaaaagtacctaatctcattagcaatcaataaatacacattaaaaccacaataagmtgccactacacacgtgccagaatggctaaaactgaccataccaagtgtcatcttggtgaggtgagatgctgctgggattcataacgtgttgggggaaaatggtaagactaatttggaaaagtttggcatttactgaagttgaaccctctcatatgacctggcatttccactcctggatatgtactgaatagaaatgcaggcacacagacaccaggagacatctacataacagcttcattcataacttgataagggtggctaccagtagtagaatagataaataaattggggattactcat

SEQ ID NO: 205008 - DNA, 601 bp, Human
caatgcgggggcttttggaatgggagctctttgctccttcctggcctagttggtcgttaggcaagtattcactttgtgacaattcattgcactggatatttttgatttgggtactctgtgtgtgtatatcttaatatttttaaaaaaatagctcataatactggtttctgtcttatattttagaaaagcatttacctttttagaaaacagataacctaaatatttgaggcactaggtcagaatgcatagggtgggccgagcacagtggcttatgcctggaatcccagaacttttggaggcygaggtgggcagattgcttgagcacaggagttcaagaccagcctggctaacacagtgaaaccccatctctacaaaaaatacaaaaattagccaggcatggtggcatgcgcctaaagtcccagctacttgggggctgaggtgggaagattgcttgaacctggaagctcaaggatacagtgagctgagatcatgccactgtactccagcctagaaggcaaagtgagactctgtctcaaaaaaaaaaaaaaaaaaaaaaaagtatagggtgtttctgtttgctgtttttatataggtagccatt

SEQ ID NO: 205009 - DNA, 601 bp, Human
ctcctgcttatgtgactgacggccgccttcacccacagagagcagaagtgcgaggctgtggggaagttcaccaaggccatggatgacggcgtgaaggagctgctgacggtggggcaggagcactggaagcgctgcacgggccgtaagtccactcctcacagtgcactgggctcgtagggggtgatgcaggctcagttttatgtcccttatcatagaggggaacctgctgcctcgaacagaagtgtatttggtggacggcagtaatgtccctcctgtgattctgcttgatctcacttcaccygagttaaaccacagaaaactgaccagcaaagccaggttaagaaatctcatagggaacaccacgttcacttaattagttccagtaatttggggctttataatctttggaaaattaatcatttttgcatgttttcagagtgcttgtagttattcttagtctcatgattttattttttaatcttcatccatttggtaagatgttgtgtatttgactaaaaccatagtgtttagaaaaaccaatatagttagtagtagaaaatatgtcacagcagaagcactgccgaggggagagtgtcgctgt

SEQ ID NO: 205010 - DNA, 601 bp, Human
taagtccactcctcacagtgcactgggctcgtagggggtgatgcaggctcagttttatgtcccttatcatagaggggaacctgctgcctcgaacagaagtgtatttggtggacggcagtaatgtccctcctgtgattctgcttgatctcacttcacctgagttaaaccacagaaaactgaccagcaaagccaggttaagaaatctcatagggaacaccacgttcacttaattagttccagtaatttggggctttataatctttggaaaattaatcatttttgcatgttttcagagtgcttktagttattcttagtctcatgattttattttttaatcttcatccatttggtaagatgttgtgtatttgactaaaaccatagtgtttagaaaaaccaatatagttagtagtagaaaatatgtcacagcagaagcactgccgaggggagagtgtcgctgtcagtcacggctttctgaccactctgctgtgtccctaagaacttcctgcctccctccttctcctttgtttgtaggctttcattctgctgaaggtttttcctgtatttcctagaactgtgcagctctgtcaccacacatgtggcc

SEQ ID NO: 205011 - DNA, 601 bp, Human
tttttgcatgttttcagagtgcttgtagttattcttagtctcatgattttattttttaatcttcatccatttggtaagatgttgtgtatttgactaaaaccatagtgtttagaaaaaccaatatagttagtagtagaaaatatgtcacagcagaagcactgccgaggggagagtgtcgctgtcagtcacggctttctgaccactctgctgtgtccctaagaacttcctgcctccctccttctcctttgtttgtaggctttcattctgctgaaggtttttcctgtatttcctagaactgtgsagctctgtcaccacacatgtggcccaggatagaaaaatagtcccgtatccagctgtagggctaatgccacgggctgctgccctgttacacccacaggctcagaggctgcagagtgacttgtcaggccctgaaatgctgcgactgcactgctgtcccatgcgcagatgcctttaactcccttagagtcctaggacttctctcctttatatctggtctgcccttattgctgtgtcttaacctctagagaacagggccttctaatctatcactaagaattttctggccttcacctcataacac

SEQ ID NO: 205012 - DNA, 601 bp, Human
tttatatctggtctgcccttattgctgtgtcttaacctctagagaacagggccttctaatctatcactaagaattttctggccttcacctcataacaccatacaggaatattggttgtattcagttaaaaaaaatgttttatattttgaattatgagtaacatatacctacttttctatcagcctttgatgctcagcataggaaagggatctgttcttgtaatgatttttttaaaggtgatatttttacactaaaaaaagaaaacaatcagaatttgaaatccaataataattttaaagacaggaaactaaatatggagtgacttgtagatgaattaataagatagcacagcaaagacaatgtcagtattactattcaatccagatctgaaaatccaaagccttacatcaggagtcagtaaaccatggtccgagcaccatatttggcttgccacttattttgtaaataaagttttattggaacacacccatgcccatttatttgtatattgtctttggctacatttgtgtcataatggtagagttgagtagtttcaacagaaacttgtggctccataaagcctaaaacgtttactatctgg

SEQ ID NO: 205013 - DNA, 601 bp, Human
agctgttcgtgcttgaggggcagacatcaggaataacagttgtttctttcccatggcaaagaaatatgatgctgtatcctaaatatatagaattagccctgagaaaataatgtatacaaatgcagcatctagaaaacaaaacctgtgtcaagactttagtcatagaggatgactcaggaacaaaaagcaaagttgacgttgttctctaaagcagaggcccccaatccccaggccatggactggtacatggaccattaccgcacagcaggaggcaagtgaagcttcatctctatctacaggygctccccatcactcacattaccgcctgagctccgcctcctgtcagatcagcggtggcattagattctcatagaaatttgcaccctattaagagccacgcatacaagcttgtgagcccttatgagaatctaatgcctgataatctgaggtggaacagtttcatccccaaaccatccccccgacccactgtctatctgtggaaaaattgtcttccatgaaaccagtccctggtgccagaaaggttggggaccgttgctctaaagtataaatgaaagaattcagtttttaaaggcaatgaatt

SEQ ID NO: 205014 - DNA, 601 bp, Human
acgttgttctctaaagcagaggcccccaatccccaggccatggactggtacatggaccattaccgcacagcaggaggcaagtgaagcttcatctctatctacaggtgctccccatcactcacattaccgcctgagctccgcctcctgtcagatcagcggtggcattagattctcatagaaatttgcaccctattaagagccacgcatacaagcttgtgagcccttatgagaatctaatgcctgataatctgaggtggaacagtttcatccccaaaccatccccccgacccactgtctatcygtggaaaaattgtcttccatgaaaccagtccctggtgccagaaaggttggggaccgttgctctaaagtataaatgaaagaattcagtttttaaaggcaatgaattaattttgactgtaaactcttgcaagaccatcataacacatcatttaaatctgtatgttctttgaaagccatttttcctgagtgtaaattttacaattgcattttttaaggatatcataaaaatttgggattatgatatctttttaaaaattaaatcccttatgtctaatgtctgatcaactccatgtcctgtgta

SEQ ID NO: 205015 - DNA, 601 bp, Human
tttgcctttttttgctctctggtgtagcgcttttgtttcaatgccatcagtttcatttctctgccaagtcttcctgtgacagaggccagatttggctgggcacagtggctcacacctataattccaacactttgggaggctgaggtgggcaaatcacttgagtccaggagtttgagaccagcctgggcaacatggtgagacccccatctctacaaaaaaataaaaaattagccacgtgtggtggtgcatacaggtagttgcaactatttgggaggctgaggtgggaggatcacttaagccygggaggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttacccagggatccctttgtggtttacattggcagcacttatgagagcaagttagctctttttctttattaaaagggaaagga

SEQ ID NO: 205016 - DNA, 601 bp, Human
gtggctcacacctataattccaacactttgggaggctgaggtgggcaaatcacttgagtccaggagtttgagaccagcctgggcaacatggtgagacccccatctctacaaaaaaataaaaaattagccacgtgtggtggtgcatacaggtagttgcaactatttgggaggctgaggtgggaggatcacttaagcccgggaggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttacccagggatccctttgtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctg

SEQ ID NO: 205017 - DNA, 601 bp, Human
taaaaaattagccacgtgtggtggtgcatacaggtagttgcaactatttgggaggctgaggtgggaggatcacttaagcccgggaggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttmcccagggatccctttgtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccaatatgggcaacagagtgagaccccatctcaagaaaaaaagaagaaaa

SEQ ID NO: 205018 - DNA, 601 bp, Human
gtgtggtggtgcatacaggtagttgcaactatttgggaggctgaggtgggaggatcacttaagcccgggaggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttacccagggatcccttygtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccaatatgggcaacagagtgagaccccatctcaagaaaaaaagaagaaaaagcatttgtcagcta

SEQ ID NO: 205019 - DNA, 601 bp, Human
ggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttacccagggatccctttgtggtttacattggcagcacttatgagagcaagttagctctttttctttattaaaagggaaaggaacccrggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccaatatgggcaacagagtgagaccccatctcaagaaaaaaagaagaaaaagcatttgtcagctaggtggcacctattaaatctgttatctcctgtcacttatagaagtggtagaattggtacaggtgttgatcc

SEQ ID NO: 205020 - DNA, 601 bp, Human
ctccttaactcataactgtttcagcttatcctataaatgtgtatcttacccagggatccctttgtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccmatatgggcaacagagtgagaccccatctcaagaaaaaaagaagaaaaagcatttgtcagctaggtggcacctattaaatctgttatctcctgtcacttatagaagtggtagaattggtacaggtgttgatcctgatactcaaggcagacagtgctttggatgtcggtttctgaatattttaataataaactaataagaagtttctcaccaaaatgtaagatttagggctcccacatggcaatagttctcattgccctggccttaccatgtcttacagttgacacttttagaccagaagcg

SEQ ID NO: 205021 - DNA, 601 bp, Human
cttaccatgtcttacagttgacacttttagaccagaagcgggctttgaggtctagactgggaactcaaggccagaacagagaagcatcttggcccaggtaacaagtgggtgatggaagagctgagagcaagccacgcccattgcttagggaggaggcagaggtcttggagcccttttagcatggtggctctgtgatgtctcaacagggtgagaagatttgtcctagagatgctggaattttggccatcatgatggcccggctccacaggcatccatgggttccccactgggagctgcttcrtgattctttaacattttctggactgtgattatcaatacataattaaatgttccatattgcaaatagcactttttcaagtattaaaaatactcagtgtatgttttatgttgaatatcattctacttaagataatattttaaggaagcattcaagttcctgttgactggcttttctcccattacaaaggacagtgaaggtcagcagtgtggagtactgtgtccatcacatccacttgctcagatgtgttggcgtcttagagcagtgctatactatgcgatcttgcaataatgtaaatgggtt

SEQ ID NO: 205022 - DNA, 601 bp, Human
gtcttggagcccttttagcatggtggctctgtgatgtctcaacagggtgagaagatttgtcctagagatgctggaattttggccatcatgatggcccggctccacaggcatccatgggttccccactgggagctgcttcgtgattctttaacattttctggactgtgattatcaatacataattaaatgttccatattgcaaatagcactttttcaagtattaaaaatactcagtgtatgttttatgttgaatatcattctacttaagataatattttaaggaagcattcaagttcctgtygactggcttttctcccattacaaaggacagtgaaggtcagcagtgtggagtactgtgtccatcacatccacttgctcagatgtgttggcgtcttagagcagtgctatactatgcgatcttgcaataatgtaaatgggtttgattcctggaaatattgtgattatagtaaaaataacttccagtgctcctttacaagttcatgtactaacttgaaataatacagactattagcatggcccctgcacaaaaccatgaaacattgcatattcttatggatgagcatatggaaatataagcaat

SEQ ID NO: 205023 - DNA, 601 bp, Human
ttcgtgattctttaacattttctggactgtgattatcaatacataattaaatgttccatattgcaaatagcactttttcaagtattaaaaatactcagtgtatgttttatgttgaatatcattctacttaagataatattttaaggaagcattcaagttcctgttgactggcttttctcccattacaaaggacagtgaaggtcagcagtgtggagtactgtgtccatcacatccacttgctcagatgtgttggcgtcttagagcagtgctatactatgcgatcttgcaataatgtaaatgrgtttgattcctggaaatattgtgattatagtaaaaataacttccagtgctcctttacaagttcatgtactaacttgaaataatacagactattagcatggcccctgcacaaaaccatgaaacattgcatattcttatggatgagcatatggaaatataagcaataaaaattcttaaatgattatagggaaggagagagagagatggaaggtaaactgattatatcttgttttgtacagttgactttggaataatgtaaatgctttacataattattagaaaacaaatttaaatcaaaatg

SEQ ID NO: 205024 - DNA, 601 bp, Human
cttccagtgctcctttacaagttcatgtactaacttgaaataatacagactattagcatggcccctgcacaaaaccatgaaacattgcatattcttatggatgagcatatggaaatataagcaataaaaattcttaaatgattatagggaaggagagagagagatggaaggtaaactgattatatcttgttttgtacagttgactttggaataatgtaaatgctttacataattattagaaaacaaatttaaatcaaaatggaaaaaaaatttctaatcaaaagcaaaataaaacaaatgwtacatcaaaatgaaggcatagcacacagaggaattgtttcaaaacaccttaaaatggcattttatatgcccccaggagcgggtgcctcaaggtcagaaagactataagaatgttagttgttttcactaaacatgtagtcaatatcatgttggtattgttattctaaaacttctaaaactatttacatattgtaggataaagcaaatacgtaattatgttactgttgttagcaattaagatttttaaaataaaaagttttaaaataaatgaagaaaacccctaaagtcataaatttgcttt

SEQ ID NO: 205025 - DNA, 601 bp, Human
ataagaatgttagttgttttcactaaacatgtagtcaatatcatgttggtattgttattctaaaacttctaaaactatttacatattgtaggataaagcaaatacgtaattatgttactgttgttagcaattaagatttttaaaataaaaagttttaaaataaatgaagaaaacccctaaagtcataaatttgctttggaaacagtgtgaactcattacatgatttccttcttaaaaaaaaatacagtttgcctttctgttaaagctctagaaacagttacccaatccagtagcaagaagyattccctggcaccaatcgtaaggtccacgtcccaccacagtgaaccagggttcctatcaaaagacttagataccaattggaagagcctaccactggccaaagaaaagaaaatgtgagcattagtgaaaataataattaatgtggaatgaagcatatcaaatatttttaaatccagaattataaagatgctttttaagaaattaatctcagttacttttggagaatggtggtggattaactcattattttgaaaactataaagagaaagaattaagcacttaacctgcttttcctgttcaa

SEQ ID NO: 205026 - DNA, 601 bp, Human
gcaaactcatactaaaataaaagatccagacaatggtcattctaggtaacgatcattttctaacattctaagagtagaaataactgaactggtggtgtgtgactctgatcaggcctctaggtctaatagccagtgtgaagagaacacagggacaggggagtgtgtgacatatcaccagagacacagccagcagcatccagaatgcaggcaccagggcacacgacaaattcaacaccccacgaaaagaaaggtgcagggaaaaaaggggccgagggagaagaatccacagagttaagaaacrcatcagttctgtgccgtatggacctttacatcctgattcaagcagccagctctccctgagaggcctcattatagccgaatgacagtctcgtcataggtgtcataatggtactgcctcatgttttagagtcctcatctattaggcaagatttatgaatgagatgctgatgtccggtgaaagcgggtcggggtgtagacgaacacaggctggcgagagctgccagtggggaaggcagatggtgggtgatgggcattcattctattcccaatagttttgaaaatgtttgaaagtttctataat

SEQ ID NO: 205027 - DNA, 601 bp, Human
ggtgtgtgactctgatcaggcctctaggtctaatagccagtgtgaagagaacacagggacaggggagtgtgtgacatatcaccagagacacagccagcagcatccagaatgcaggcaccagggcacacgacaaattcaacaccccacgaaaagaaaggtgcagggaaaaaaggggccgagggagaagaatccacagagttaagaaacgcatcagttctgtgccgtatggacctttacatcctgattcaagcagccagctctccctgagaggcctcattatagccgaatgacagtctcgtcrtaggtgtcataatggtactgcctcatgttttagagtcctcatctattaggcaagatttatgaatgagatgctgatgtccggtgaaagcgggtcggggtgtagacgaacacaggctggcgagagctgccagtggggaaggcagatggtgggtgatgggcattcattctattcccaatagttttgaaaatgtttgaaagtttctataataaaatttaccaataaaatcaataataaaattttaacaagtgaaaagaaaatatgcataacttataaccactgataaaattgatcattttcagg

SEQ ID NO: 205028 - DNA, 601 bp, Human
tcatagctacatagcttttattggagtctttagtaccccagtttcaggggctttttagataacagataataagttcccttaagaagaatctaagttattttctaatcccttaattaaaaaaaattttttttcagatgactttaaactatgtgtatggatgcacacatgtgtacacacactaatgtggttgtgggctactttgctgatacttctaaaaaagcattcattttaataacatagctattaaagttataattcagaaaaaatggaaaaatttaaaattaccacttaaaatgattagttttaatatttttatattctctgctcatatttagaagttaaactacaacaactcatttgtttgtgtgtaaacatacagcattagctgaacttccttcatggtggtattattttgggccacgtcaaaataactaattttacaaaccaacttaaaaattacatgatgttttgttgttttctttacaacatatgattcaaagtatggcagtcttgggagttattttcttttagaaaaagtgatctgaatgcttaacactcaataatttagtgtagcacatgcaggatttatagtctttgggta

SEQ ID NO: 205029 - DNA, 601 bp, Human
attggtttggggtgtcctcacatatgaattctggttttctctccctttttaaaaatctgtacatcacctcaggcatgagttgtgagtattttatattttatgtcaaccatagtagtctatcgtatattatgatgtacttggatttgttaggaaaatctctgcaaagggctggtctgtgatcttaacagtcctggcatgtggccattttagcattctgctttataacttaaatatcatgaaggggtaccataggtaaattaggtttgtacaacttcagataacttaatataaaactcagaamaattagcttgctgtcgaaatgtatgccagcagcatcagagttgtaggcctggagcctaattaatgcatgagtatagagttgttccttccagacagcggtaaataacgagcagcgtgatgacactggagtgggaaatgtttggcagcttttctagccgcttccatctgagtctttaaatggattcagcgcctcttaaaaaatcaaaggaaagcccaggacttagaatcagcacacttaggcactagcttataaaatattctgttgtataaaaaaagagagagagtgcctgtgtgcacatgc

SEQ ID NO: 205030 - DNA, 601 bp, Human
catcacctcaggcatgagttgtgagtattttatattttatgtcaaccatagtagtctatcgtatattatgatgtacttggatttgttaggaaaatctctgcaaagggctggtctgtgatcttaacagtcctggcatgtggccattttagcattctgctttataacttaaatatcatgaaggggtaccataggtaaattaggtttgtacaacttcagataacttaatataaaactcagaaaaattagcttgctgtcgaaatgtatgccagcagcatcagagttgtaggcctggagcctaatyaatgcatgagtatagagttgttccttccagacagcggtaaataacgagcagcgtgatgacactggagtgggaaatgtttggcagcttttctagccgcttccatctgagtctttaaatggattcagcgcctcttaaaaaatcaaaggaaagcccaggacttagaatcagcacacttaggcactagcttataaaatattctgttgtataaaaaaagagagagagtgcctgtgtgcacatgctgccctgtacctagccacatgacttccaaaacctgctaatgcctgatttccattacgtgct

SEQ ID NO: 205031 - DNA, 601 bp, Human
gtacaacttcagataacttaatataaaactcagaaaaattagcttgctgtcgaaatgtatgccagcagcatcagagttgtaggcctggagcctaattaatgcatgagtatagagttgttccttccagacagcggtaaataacgagcagcgtgatgacactggagtgggaaatgtttggcagcttttctagccgcttccatctgagtctttaaatggattcagcgcctcttaaaaaatcaaaggaaagcccaggacttagaatcagcacacttaggcactagcttataaaatattctgttgyataaaaaaagagagagagtgcctgtgtgcacatgctgccctgtacctagccacatgacttccaaaacctgctaatgcctgatttccattacgtgctactcctcaaatggcagcggcttctgaatattacagagatggtgtgctgtttgcttttctcttttgttgtagcataaaactgttcattttagcttagtgacatttgtcaagaatagcaacctttttgcttccaagggacttgaaggaagttaaatttagatgctttcctctcttcttattttgtggaggtatttcctgttcagta

SEQ ID NO: 205032 - DNA, 601 bp, Human
tttaaatggattcagcgcctcttaaaaaatcaaaggaaagcccaggacttagaatcagcacacttaggcactagcttataaaatattctgttgtataaaaaaagagagagagtgcctgtgtgcacatgctgccctgtacctagccacatgacttccaaaacctgctaatgcctgatttccattacgtgctactcctcaaatggcagcggcttctgaatattacagagatggtgtgctgtttgcttttctcttttgttgtagcataaaactgttcattttagcttagtgacatttgtcaagratagcaacctttttgcttccaagggacttgaaggaagttaaatttagatgctttcctctcttcttattttgtggaggtatttcctgttcagtagcaaatcagttatagaatatattagcattgttatattttaaactaatgactaatcatttcagctttattcatactgttgcattttatatttcacagggagcaatagaaaaagtgaaagaaagtgacaaactagttgcaacaagtaaaatcaccctacaagacaaacagaacatggtgaagagagtcagcatcatgtcttacgcgttg

SEQ ID NO: 205033 - DNA, 601 bp, Human
aaatttagatgctttcctctcttcttattttgtggaggtatttcctgttcagtagcaaatcagttatagaatatattagcattgttatattttaaactaatgactaatcatttcagctttattcatactgttgcattttatatttcacagggagcaatagaaaaagtgaaagaaagtgacaaactagttgcaacaagtaaaatcaccctacaagacaaacagaacatggtgaagagagtcagcatcatgtcttacgcgttgcaaggtaagatgaaagggtccttatgaggtgctggtggargtttttttttccccagcaaagtttcccttgatagagagaaatccagatgtgagcagcagttaagtaagtgagaccttttaagcccctcgtttgcaggatcccggtgctgatgaaaatctgtaatatttatttaatttttcacctgtccaccttatctggctatagatgacagcttgattaaaactgtacattttattatttctgagagacatttaagattccttttgtaatctgtggtatcataatgctctattaaatgccagagcccagcttttagcagtctgtaacctgcgtgccttg

SEQ ID NO: 205034 - DNA, 601 bp, Human
gctttcctctcttcttattttgtggaggtatttcctgttcagtagcaaatcagttatagaatatattagcattgttatattttaaactaatgactaatcatttcagctttattcatactgttgcattttatatttcacagggagcaatagaaaaagtgaaagaaagtgacaaactagttgcaacaagtaaaatcaccctacaagacaaacagaacatggtgaagagagtcagcatcatgtcttacgcgttgcaaggtaagatgaaagggtccttatgaggtgctggtggaagtttttttttccccagcaaagtttcccttgatagagagaaatccagatgtgagcagcagttaagtaagtgagaccttttaagcccctcgtttgcaggatcccggtgctgatgaaaatctgtaatatttatttaatttttcacctgtccaccttatctggctatagatgacagcttgattaaaactgtacattttattatttctgagagacatttaagattccttttgtaatctgtggtatcataatgctctattaaatgccagagcccagcttttagcagtctgtaacctgcgtgccttgggatcatgga

SEQ ID NO: 205035 - DNA, 601 bp, Human
ttgtgtcaagaaaaaaaaaagatgaatttctataggtttgagtgtttttgagcagatgagggcagcaagtggatttttcctgttggcggatgggtggatggcacttggatgggcagagaatggagagcgtgttctgttaggaacaaaagccacaaaattgtggtgctagattgtgtcatgggcatgaaagagtaaaacatacttagaggttattgggaaataaattttgattgtgaaggaacttgaaagctctagacttgatgcaggcattaagaagccattaaaagggagtaaaaaaaaatcaatcctcaagggagaaggatttgctggttatggaggggagattggaagatgcagacactgtccaagagcccagccagaagaccatctcactgttgtagtctgagctttgagggcctaaagatgtggtactggggagaagagaatgaagcacatttgcaggcttttccaaggaacagctttcaagactggggcattcatgggagaaagagaaggatgagggaggtgtccagagccaggccactacggcaaaaacgaggaaccctgattgaagtttcgggttttgaagggtttgaaatgg

SEQ ID NO: 205036 - DNA, 601 bp, Human
tctataggtttgagtgtttttgagcagatgagggcagcaagtggatttttcctgttggcggatgggtggatggcacttggatgggcagagaatggagagcgtgttctgttaggaacaaaagccacaaaattgtggtgctagattgtgtcatgggcatgaaagagtaaaacatacttagaggttattgggaaataaattttgattgtgaaggaacttgaaagctctagacttgatgcaggcattaagaagccattaaaagggagtaaaaaaaaatcaatcctcaagggagaaggatttgctrgttatggaggggagattggaagatgcagacactgtccaagagcccagccagaagaccatctcactgttgtagtctgagctttgagggcctaaagatgtggtactggggagaagagaatgaagcacatttgcaggcttttccaaggaacagctttcaagactggggcattcatgggagaaagagaaggatgagggaggtgtccagagccaggccactacggcaaaaacgaggaaccctgattgaagtttcgggttttgaagggtttgaaatggggagtttggttttgaacttgtgtttgag

SEQ ID NO: 205037 - DNA, 601 bp, Human
ttttgattgtgaaggaacttgaaagctctagacttgatgcaggcattaagaagccattaaaagggagtaaaaaaaaatcaatcctcaagggagaaggatttgctggttatggaggggagattggaagatgcagacactgtccaagagcccagccagaagaccatctcactgttgtagtctgagctttgagggcctaaagatgtggtactggggagaagagaatgaagcacatttgcaggcttttccaaggaacagctttcaagactggggcattcatgggagaaagagaaggatgagggargtgtccagagccaggccactacggcaaaaacgaggaaccctgattgaagtttcgggttttgaagggtttgaaatggggagtttggttttgaacttgtgtttgaggttatccaaattgagaaatacaaagctttgtataacttcaagtaactgaatgtaaaatgtagaacagtttgcatgtcatgggaatctgtgcagccgctggctttctcagcctggagggtttgggagaaggcggcataggaggcatccgagggaggcaatgaggtcctctgatgacgaagactcctctagagttggg

SEQ ID NO: 205038 - DNA, 601 bp, Human
tggggagtttggttttgaacttgtgtttgaggttatccaaattgagaaatacaaagctttgtataacttcaagtaactgaatgtaaaatgtagaacagtttgcatgtcatgggaatctgtgcagccgctggctttctcagcctggagggtttgggagaaggcggcataggaggcatccgagggaggcaatgaggtcctctgatgacgaagactcctctagagttgggggcaggggcaggggggacagagaaagaaggaatccatgtattcagcaaacatgaagaaagttgtccctcagcakccagtcctcctgccctgtgagaggttgagttctgacagcgtcgctggtgctcaggggcagcaaggcttcccgtactgaagaagggtctcccgctgtcccacacgctgcccagcctttcaccagaaacctgctgaagcaattgctgtgcaggagggagcggggcagggaccccagctgcctgctaggtccagtgcagacacaccagaggctttgaactgcagtcatctgtaacaaatatgaccaagtattttctatttgatcgattctgttagagtaataggctgcatttgggtgatttat

SEQ ID NO: 205039 - DNA, 601 bp, Human
atgtattcagcaaacatgaagaaagttgtccctcagcatccagtcctcctgccctgtgagaggttgagttctgacagcgtcgctggtgctcaggggcagcaaggcttcccgtactgaagaagggtctcccgctgtcccacacgctgcccagcctttcaccagaaacctgctgaagcaattgctgtgcaggagggagcggggcagggaccccagctgcctgctaggtccagtgcagacacaccagaggctttgaactgcagtcatctgtaacaaatatgaccaagtattttctatttgatcrattctgttagagtaataggctgcatttgggtgatttatctgtattggattttatagttttgaatatgcaagacagtgaaagtcattcatttactggaaagtaatgtttgtcattagcttgttttgttttgtttgttttgtttgagacagtctcgctctgtcacccaggctggagtacagtggtgcaatcccggctcactgcaacctccatctcctgagttcaagcaattctcctgcctcggcctcccaagtagctgggattacaggcacctgttgccatgcccggctaatttttgtattc

SEQ ID NO: 205040 - DNA, 601 bp, Human
gcaccacacaggaaaccaaaggcagcctttgctttttgtgaatgaggttttcacagtgcgccatggaaatcgcagagagaaaaccaaaaaagcgagatgtgggatggttttattcacaaaacaataacgaaaacttaaatttttcttacctctgcttagtaattttgttgtttaccagagtctatagaaaacaaaaatctagtagcatgtctccctcagacacctgcaggtaaggtctgtaatgtagaatccagcctccgctggcggccttgctgcctacccagctcccctctggccatgkgatctaagccatgttcatggggagtggtgagcaagccctctgctcagccatactggtggcatctgcgagctggacactgctgaaaacgcctgtctccagcagccagttcttaaaggagaactgtgcttgatgtacctaatgcatatttgtgaattgtgtcttggacagttggtttgggagactaacttacgggaggaactcacctaagccctgtcctcccttacaggacgtgggccctatgctctttaaatgcacacttttcccgtcagttggtgccattgtggatttgcctttcattgt

SEQ ID NO: 205041 - DNA, 601 bp, Human
catggggagtggtgagcaagccctctgctcagccatactggtggcatctgcgagctggacactgctgaaaacgcctgtctccagcagccagttcttaaaggagaactgtgcttgatgtacctaatgcatatttgtgaattgtgtcttggacagttggtttgggagactaacttacgggaggaactcacctaagccctgtcctcccttacaggacgtgggccctatgctctttaaatgcacacttttcccgtcagttggtgccattgtggatttgcctttcattgtatattagaatataacrgattacatttgtctgtgtgagaaaataatgcaagggcaactctcaaaattttgatagtgttgatttattgattttcaagtccaggtatggtatagtgacattgtaattcagaatagaaaaccatgtatttcatcactgtctttgcataaacctaagtagctgatataacattgttaggttttagatctaagttttatggcaaagtaacccttaagttactaaaatttgtgtatgtgttcatggagcagacatatattgagtgtttcttatataccaagccctcgtgctggatgtttagca

SEQ ID NO: 205042 - DNA, 601 bp, Human
cctggcgcagagaccactgcagcgcctcgttagcttcacaggcaggctcgtgctgtctgcacactcagcagtgacagcagggtgtggccagggcgacacaaccttcaggggattctggaagctcatactcctccaggaaagagggggctctaggcaaacatgaaggcctgagcccccagctcatctgaggaaaagcaggtggtctggaagcgccgctagggcagaggtggggagcatgtgtagacgcctcccggcgggaagggaccaccagggccagctcgggccccagcgctgccggtgycattcggggttaaggtctgtccagcagcaacgcggggcagggctggtgccaaaaagaccagttaaagaattggaatttgtgtcatgtttaacttgttggagttgtgaataaagaacactgtgaggtcgtaatgggagtgatatctcaacgttgttttgttttgctttcttgtcagattgcagaaaagctgaggcaggccctcagccgctttccagtgatgtaggacagaacgggccttgaagagaatgccgcgtgctttctcctgacttggggcaatgcaattcaaaactttttttcccc

SEQ ID NO: 205043 - DNA, 601 bp, Human; identical to SEQ ID NO: 82169

SEQ ID NO: 205044 - DNA, 601 bp, Human; identical to SEQ ID NO: 82170

SEQ ID NO: 205045 - DNA, 601 bp, Human; identical to SEQ ID NO: 82171

SEQ ID NO: 205046 - DNA, 601 bp, Human; identical to SEQ ID NO: 82172

SEQ ID NO: 205047 - DNA, 601 bp, Human; identical to SEQ ID NO: 82173

SEQ ID NO: 205048 - DNA, 601 bp, Human; identical to SEQ ID NO: 82174

SEQ ID NO: 205049 - DNA, 601 bp, Human; identical to SEQ ID NO: 82175

SEQ ID NO: 205050 - DNA, 601 bp, Human; identical to SEQ ID NO: 82176

SEQ ID NO: 205051 - DNA, 601 bp, Human; identical to SEQ ID NO: 82177

SEQ ID NO: 205052 - DNA, 601 bp, Human; identical to SEQ ID NO: 82178

SEQ ID NO: 205053 - DNA, 601 bp, Human; identical to SEQ ID NO: 82179

SEQ ID NO: 205054 - DNA, 601 bp, Human; identical to SEQ ID NO: 82180

SEQ ID NO: 205055 - DNA, 601 bp, Human; identical to SEQ ID NO: 82181

SEQ ID NO: 205056 - DNA, 601 bp, Human; identical to SEQ ID NO: 82182

SEQ ID NO: 205057 - DNA, 601 bp, Human; identical to SEQ ID NO: 82183

SEQ ID NO: 205058 - DNA, 601 bp, Human; identical to SEQ ID NO: 82184

SEQ ID NO: 205059 - DNA, 601 bp, Human; identical to SEQ ID NO: 82185

SEQ ID NO: 205060 - DNA, 601 bp, Human; identical to SEQ ID NO: 82186

SEQ ID NO: 205061 - DNA, 601 bp, Human; identical to SEQ ID NO: 82187

SEQ ID NO: 205062 - DNA, 601 bp, Human; identical to SEQ ID NO: 82188

SEQ ID NO: 205063 - DNA, 601 bp, Human; identical to SEQ ID NO: 82189

SEQ ID NO: 205064 - DNA, 601 bp, Human; identical to SEQ ID NO: 82190

SEQ ID NO: 205065 - DNA, 601 bp, Human; identical to SEQ ID NO: 82191

SEQ ID NO: 205066 - DNA, 601 bp, Human
acccctgacctcaagtgatctgcctgcctcagcctcccaaagtgtgagccactgtgcccagccaggtttatatttcatcttaattcttttgatgttgtaaaagtacttttaaaaaatgaattattttctcatggtaattgcttttggggaaaaaactatatataaaaaatggatttggatgtttatggcacttggcttgttaaaaaaaacaacaaaccaaacaaacaaaaaaagaaaactctaaatgtaatggttccttttttttttttttttgagatggagtctcgctctgtcgcccagrctggagtgcagtggcacgatctcggctcactgcaacctctgcttcctgggttcaagcaattctctgcctcagcctcctgagtagctgggattacaggcgcttgccaccacgcctggctaatttttttgtatttttagtagagacggagtttcaccatgtttgccgggctggtcttgaactcctgacctcatgatccacccgcctaggcatctcaaagtgctgggattacaggcgtgagctaccgcgcccaacacccccctccccaccctttttatttttttaaagaaatggttctcactc

SEQ ID NO: 205067 - DNA, 601 bp, Human
catatgagggcttctatttctccacatcgtgaaacattttattttgaataaaaagtaaatgtttatatacctggactgaagagtactattgccttcaggtaggcatattcgtatccatcaatgcagagtttaaccatgctgttacaaaactcctgtagtttgaagatgtgctccatcaataattttcttctttctgttgacattttatctttaattaaaaataaacaaatgcttctagtgtttgtctaaaatgaacaactactttcatccaatatatttccctctcaggaattttgaaaawttttttaattcttaaattttttttgagacagggttttactcctgtcgcccaggtggcagtgcagtgcagtgcggtgatcttggctcactgcaacctctgcctcctggactcaagcagttctcctgcctcagcctcccaagtagctgggactagaggcgcatgccaccgcgcccagctaatttttgtattttttgtaggatggggtttcactatgttgcccaggctgttcttgaactcctgggctcaagtgattagcccacctgtgcctcccaaagtcttgggattacaggtgtgagccac

SEQ ID NO: 205068 - DNA, 601 bp, Human
ctgggcgacagagtgagactcagtctaaaaaaaaaaagtatacaattcaatagtttttagtatgaatatactgataattgtacaactatcactacaatctaattttggaacatttttgtcactccaaaaaaaacactctacccattagcagtcacttcccatttcttccttctccttagaccctggcaaccacttacctattttatgtctatacaggtttacctattttgcgtattttatataaatgaaatcaaacaatatgactggcttctttcatttagcagaacttttaaaggttcaactgtgttgcagtatgtgttagaatttccttccttttatggctgaatgatattccatcatatgtatatattaaatttatttcttcatctgttgaccgacatttgggttgtctccactttttgactattataaataatgctgctatgactatttatatacacattcttgcatagatatatatttttcatttctcttgggctgacaagagtgaagctgctgagtcatatgataactccatgtttaaccttttgaagaactactgaactcttttcccaggtaactgcaccattttacatcccca

SEQ ID NO: 205069 - DNA, 601 bp, Human
agcttaagaaatgttgaatatggaaagctctgttctcatggatgaaaattttaaaaagtactaaatggaaaaacctaaaaatacttagtaaaataaaattacattagaatttaaacttcaaatctatgttccttcaattttcacctaaggaaaataaaggtgacaaattgtgctaagaatagagacatacgttactaactcataagaaacattagaagaaatagtacaagctttcatgttcttactggtattactgacagaaagaagcaggtttcctcagataattttattatgatgcacragaacagaaacatatcagaatgaaaaatacagaacctaagagaacagtcaatttctcttattcagaaattgatcactgagagcttaccgtcattttaccatctgtgaaaactgtaaactggcaggaaaacaagaaaccagttttttaaatttgttggtaactcatataagatgtttggaaatctagcccatcaacatagcaatagtcatctctcattctgccatttagtaatgcctaaaaaaatacacctaagaattcaaatgttgacgtgacaacagaaataaaggtctataacatttt

SEQ ID NO: 205070 - DNA, 601 bp, Human
tgaggcaggagaatcacttaaacctgggaggcagaggttgctgtgagccgagacagcgccattgcactccagcctgggcaacaagagtgaaactctgtcttaaaaaaaaaaaaaaaaaaaaaaaagtgtggctcattcattccacaaatattgattgaggccacctactatataccaagcactatattttacatatttaaaattattttttatctcgtatacatatgctaacaactaataaaaaataagcgggtgttaccaaaacaaacagctttctctccattccaaaagtagtaagaakgcatttgataactttgcctttaataggagcaaaaggtaaatgactcagcttaaaaagacatcttaaggctgggtgtggtggctcatgcctgtagtcccagcactttgggaggccgaggtgggggggatcacaaggtcaggggttcaagaccagcctggccaacatggtgaaaccccgtctctactaaaaatacaaaaaattagctgggtgtggtggcaggcacctgtaatcccagctacttgggaggctgaggcaggagaatcgcttgaaaccaggaggcggaggttgtggtgagccgag

SEQ ID NO: 205071 - DNA, 601 bp, Human
acgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaatttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaa

SEQ ID NO: 205072 - DNA, 601 bp, Human
gagctcaaatgatgttagagaataagggcaaactgaggctgtggcctctacaactttgcttctcaaaatggggtctgtggaccagcagcattagcatcactggggagcttgagctccaccccagacccgctgattcacaatctgcattttcacaagacccccaggggactgtttgcaaatgcaggtttgagaagcattgcttcaggtgaccatatctatttggatgtatacattcagggacacttctttttgtcaaatatttctgcactattttagaatcacccccttaccccctctcccygtccctctcctcaactctgccacccacctccactctgcacccaggcaaagtgcttgtctgaaaagctccagggacctgcctggcaatgctcttcatgacaatattctagttagggtcgtcgtctcttcaaggggcttcctgcttgactttgtggtatatttctctgcctgtccacattcacttacatgcctgcaatttctagcatcccttcgtacctcatctttgtatctgaggctctgggataatctctcctcgcaaccttagtgcttctacagtaagagtgattgccagtggtcttgc

SEQ ID NO: 205073 - DNA, 601 bp, Human
tgcgggtttaaggaatttggctcagagccggtactagtttctttcagtgttttgtgcatcaacctagatacctttatcagtgcctgggaatgttcaagggtccagtctggacctaagcctgctgggaaaaaccagcagctggaattagccgggcatggtggctcatgcctgtaatctcagttactcgggaggctgaggcatgagaattgcttgagcccaggaggcggaggctgcagtgagctgagattgcaccattgcactccagcctcggtgacagagggaacttctgtctcaaaaaaaacaaaacaaaacaaacctgcaggtggctgggtcacagagtggtcaggggattgtgtaatttttggttaggacaccgaaagcggcggtggggaggtgaggggaaacctgggggtcccacacacagctattagatttccctcctaaatcagtgttagggcctagatttcagggagccagattctagccctcaccctcattctttaagtgggcagggacacttttttcctttttccaaaaggaaagtcatcaaacaagcatgtggccctttcactttcctcttggccttaaaaggttaatgaac

SEQ ID NO: 205074 - DNA, 601 bp, Human
ggctttccaggtggggggaacagatggggcaaagggtgcatagaagcatgaacttggtggacttgaggaacgggaggagcttgctaggtgaggtgcaagtgatgaggagtcaatgggggacccaagtgccagtgagtttgggctttccttaagtgtgctcgaaagcctctggaggcttttatgaaagagaatacatcttaggagcatttcaaaagatgtctcggtggagggctcagttagagggagtctttcttgatggagaagagaccatagggagcaagaatagaagaaggtgactcargtaggtttatttctgtacgccaggtgacagacgatgctgtcttgaattcaagagatggagagggagaatgggggaaggtttaggaggtagagggcctattgaaggattcgatgcaggctgtgaacaaaagcagacaattgtgggtgacgcttagatttttggtgatggttgggcagtggtgtttattgagatgggaaacacttaggtgaaagagcttgtaaattcggagaccttatacaaaggtagtggcttagataattatgttagtagagttctttttttgttccattcttaagtgat

SEQ ID NO: 205075 - DNA, 601 bp, Human
aactcatgtgaggctgcttcagatttcatttatcctacttacaagaatatgcatatgtttccctatagaaacattaatgcacttgcttcaggcctgccactccagccattgctgaagtattacatgatctgtggttatatgcaatgtatttattttctaaaatctgaaaaatctatgagctctgaaacatatctaacctcaagagtttcagataagtgattgtggaattacagttcccagatttagctaactacatacatacgtacatacaggatgcttagtgaaatttgattgcagatayacaatgactactttttctggtgtatgtctcatggactatttggtacctacttattctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtt

SEQ ID NO: 205076 - DNA, 601 bp, Human
ttctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaagraaatactcaatattggtgattttattattgttaattattattattactactctctcccttcatccttgattaaatctaaaaacagaggctggtatttagggaggatgcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaact

SEQ ID NO: 205077 - DNA, 601 bp, Human
gcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaaggaaatactcaatattggtgattttattattgttaattattattattactactctctcccttcatccttgattaaatctaaaaacagaggctggtatttagggaggaygcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaactatggtcccttgcaatttgaagtcacagttcccctgcagaaagtgcagccctgtgccccgctgtgaattgtgaatgatgaattgggaggctgcaactagagttttct

SEQ ID NO: 205078 - DNA, 601 bp, Human
ttccaggggtgtctggaattttaacataaaagttaaaatcagtgtcaatatgctttgtttgaggagggtactgtctacaggctccttcaaaatcaatagaaatgcaagtaaattgttaagcacagggtttttgtatttgctagcttccttttaaaaatcaaaaattttatttctcagctccattgaagaaataaaaaaagagcaaaaattagaagaaaggtcgctcataaatccgtcacaagaaataactgctaataaagcaactggggatatttctttccaggttttgttgcatgtgtgkgtccatatgcataacttcatatgcacacctatatattgtaaaaattagctgatattatacatactactctaacttaatttttaaaattagttggtattatacatactactctgtaacttaaaactatgcattcctcatagacatagattatgtcagtagataacttttcttttctttccttttctcttttcttttctttcctcttgtcacccaggctggagtgcaatggcacgatctcggctcactgcaacctccgcctcctgggttcaaacgagcgattctcctgcctcagcctcccga

SEQ ID NO: 205079 - DNA, 601 bp, Human
tatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacaygcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctat

SEQ ID NO: 205080 - DNA, 601 bp, Human
actctgcattaatgaacagaaagagatgattgtgattcatagaccatttatttgtaaataccttctggctgagattcaaatagttctcgtaattaaacaccaccccctccccaaataatctttttttctgtaaatgatcctagccaaatcatcttttgcagacaatggaaatctgaaaacttcagttcctataaagtcatttagtgattaggaagttcagattattgaaaacagtgaattgtcattttcctcatgttgtatgtatagtagagctttgacttcataaagttcttaatttttwaaaattattttattattattttttgagatggagtttcactcttgttgcccaggctggagtacagtggcaccatctcacctcactgcaacctccacttcccaggttcaggtgattctcctgccttggcctccctagtagctgggattacaggcgcctgccaccatgcccagctaatttttgtatttttagtagagacagagtttcctcatgtcggccaggctggtcttgaactcttgacctcaggtgatccgcccacctcagcctcccaaagtgctgggattacaggtgtgagccaccgca

SEQ ID NO: 205081 - DNA, 601 bp, Human
caaagtgctgggattacaggtgtgagccaccgcacccggccacttcatgaagttctttgaaacaagtaatatcagactagcaaatgtggggatgcagtggggaagtgctaaggaccaagcatccattgtggtgggctttttattactagtgaaaactcagcttctgtaattttgtgtgagtctcctatgtaaactgggtgcaccccttcagagaagattcccatttttctcagatcatgctggctctttttcacgtggccacatagaaagcaacaaattgccaagttacaaatatatcacyacagtcctatatgtgcaaaggggtgctgcatgaagatttgggcctgtattgaagacttttggaatgtgagattaaataattttacttgaaaagtttgttgttattcatagttttcctgctctgatataccgtttgagtattggtaggtgtgcgtgctgcatggagtgtggggagaaggtaagaagttgtcagattagggctgggcgtggtgactcacacctgtagtcccagcactttgggaagccgaggcggttgggtcacttgagatcaggagttcaagaccagcctggccaacatggt

SEQ ID NO: 205082 - DNA, 601 bp, Human
ttgtcagattagggctgggcgtggtgactcacacctgtagtcccagcactttgggaagccgaggcggttgggtcacttgagatcaggagttcaagaccagcctggccaacatggtgaaaccccatctctactaaaaacagaaaaaattagctgtgcatggtggcgggcgcctgtaatcccagctacctcagaggctgaggcaggagaattgcatgaacctgggaggcagaggttgcagtgagccaagatagcaccactgcactccagtccgggcaacagagagagactccagctcaaaaamaaaacaaaacaaaacaaaaaaaacagacctagtgctagatatgaaatattcccaacacaaaaataatgataaatgtttgaagcaatggatatcccaattacccagatttgatcattacacattgtattcttgtatcagataatcacatgtaccacataaatatgtaaactataatgtatccataatcattgaaaattggaaaactggacaaatatagaaatttttttttctgaaggctctgtggaagatgtgaatgtatctctaggatatgttctctttctaaatagctaaatgaactaa

SEQ ID NO: 205083 - DNA, 601 bp, Human
ctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactsggaggttgcagtgagccgaaatcgctccactgcactccagcctgcgtgacagagcgagactctgtctcaaaataataataataataataataataataataataataataataatgtcccctagactatcctcatggaaattacaatctgcatcttatgagtgttcccataggtattgtaatcaatactctagaactgtcctgctcagcatggtagccgctagccactgtggcttttgggtacctgaaaatatggctaggtggaattgaggtgtgatgtaagtgtaaaatatacaccaaa

SEQ ID NO: 205084 - DNA, 601 bp, Human
caaatccaatgagatgcgtagaaagtcttctacacatggttcaataaatggaatccgttgctactgttaatttcacaaggattaatgttttaaaagcacttggcacatagtagatgcttaagaaatgttctgcagccaaataaaaataacttagaagaagaccttgacatcactattaaaataaaatattgtgatctagttttttttctcaaactccccacatgcctgtaaataaggaagctggttctgaaagaggcaaggctggagataaaaaacagcagatgaggacatttgtacgtawtcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaaaaattctaccaatttcccttcttttttcggacatggagtctcactctgtcgccgaggctggagtgcagcagcacgatctcggctcactgcaac

SEQ ID NO: 205085 - DNA, 601 bp, Human
ctcaaactccccacatgcctgtaaataaggaagctggttctgaaagaggcaaggctggagataaaaaacagcagatgaggacatttgtacgtattcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaraaattctaccaatttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccag

SEQ ID NO: 205086 - DNA, 601 bp, Human
tttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccagcgtgcacagcccycatttccctttgttctctcttctttcttatccctaggggatccttaacttgagtccacagtcttcccacaagagggctgtcaatacaattcaggtacttggatgggaaaaaattgcacctttgttttcactaacctctcacagaattttagcattttctttaattatgaatgtaggcaacaaaccctggtactattagcagtgcctgtgactttgttaccaacagcaatcatgattatttttctaccttattgcagatgttgcaggtatcttgaaatgttatgtacacgtatcactactt

SEQ ID NO: 205087 - DNA, 601 bp, Human
caacatgttgaccaagtctccagaataatataagaaaagagattttctttctcttgctgatttacacattggtctggatacataccagtgaaagtaaattcagacataaaattctactcttttaattgaggtcaaaggtgttggtgtcagcctggaatctctgagctgtggagaagaggaagttggggtttgaaagctgcaggtggctgccagaatgagacaagtctagtggggaatgcgtgggaggtgctgggtgaagaaaggaggcaattgtgtttcgcctgaggtctgaaggctgcayagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggattcatttggaataatttctatattggcttctttcatttaaatccaaatatagcttcagtatttctgacatatttattactttccagaatggaaatactagttcttctgaagtggtagctattt

SEQ ID NO: 205088 - DNA, 601 bp, Human
gaagttggggtttgaaagctgcaggtggctgccagaatgagacaagtctagtggggaatgcgtgggaggtgctgggtgaagaaaggaggcaattgtgtttcgcctgaggtctgaaggctgcatagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggaktcatttggaataatttctatattggcttctttcatttaaatccaaatatagcttcagtatttctgacatatttattactttccagaatggaaatactagttcttctgaagtggtagctatttagttatagtcaattttgttagttatgtttatttgacttcaaattaagccagagaatatgcaaacactgcagtgtcttccacagccttaccaaaatgaataccatatttcatcaaatcaaaaatattgtcaactgtaagatgcaccattgtttcacatgagctaagaaagagtaagcta

SEQ ID NO: 205089 - DNA, 601 bp, Human
aaatcaaaaatattgtcaactgtaagatgcaccattgtttcacatgagctaagaaagagtaagctattacatgacgcttttttatcacttggaattttattttgtgttcattgaagttcttttagcctgacttagacataactgtttaaaaatattttaacttttattataggtttaggggtacatatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagagcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacatt

SEQ ID NO: 205090 - DNA, 601 bp, Human
tttgtgttcattgaagttcttttagcctgacttagacataactgtttaaaaatattttaacttttattataggtttaggggtacatatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagarcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacattcaatagctaggctttagtgtgtctaaggacatagtatgtcactgaagaaattcagtacctctccagggtacatggatgttttaatttttcttccatttgt

SEQ ID NO: 205091 - DNA, 601 bp, Human
tttattttcatgaacagttaaaataggtgtagggactgatatttatgaaagagagcagcacaaacacaaatatgtgctaatatactcataagtttacctatgtcactaggcagaaagacttcctatagtggccatttagattaagttccgaattgaactgcttctactacccactggtctatcctaaattcacaagttcacttctttaaggctcaagcattttttttttcttttgagacagagtcttgctctttcaccaggctggagtgctgtggcatgatctcggctcactgcaagctcygactccctggttcaagcgattctcctgcctcagcctcccaagtagctgggattacaggcatgtgccaccacgcccagataatttttgtatttttagtagagatggggtttcactatgttggccaggatggtcttgaactcctgacctcgtgatccgcctgcctcggcctcccaaattgctgggattacagacgtgagccaccgcgcccggccggcccaagcatttcttgatactcattttatttcttcagagaatcatttgttttctctactgtcttcactctaattctgtgatgtcagc

SEQ ID NO: 205092 - DNA, 601 bp, Human
gttgttctcaaagtgtattcccccgatctgcagcatcaacattacctggcagtttgttagtaatgcaaaatcctgggtcccaccccagacctactgaattagacactcaagttaaaacacagccatttgtgttttaacaagctcccattttttttttttttttaaatttttgagacggagtttcactcttgttgcctaggctggagtgcaatggcacggtcttggctcactgcaacctcaaccttccaggttcaagtgattctcctgactcagcctcccgagtagctaggattacaggcayccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttag

SEQ ID NO: 205093 - DNA, 601 bp, Human
aatttttgagacggagtttcactcttgttgcctaggctggagtgcaatggcacggtcttggctcactgcaacctcaaccttccaggttcaagtgattctcctgactcagcctcccgagtagctaggattacaggcatccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttaggtgccccaggagtctgtgtccctggtcaaaaatagggtgacagggcaaagggagtagatggctcatcacaaagacattgcaccactgcaaaaagaagttatgatgtaaccagggaaggtctttccttcagttatggtggagagatctgtcagggaattccatga

SEQ ID NO: 205094 - DNA, 601 bp, Human
tgtgaggatgagtcaggagaatcgcttgaacctgggaggcggaggttgcagtgagctgagatcctgccactgcactccagcctggcgacagagcgagactccatctcaaaacaaacaaacacacaaaaacaaaaaacaaaaaatagctgggcatggtgacatgtgtctgtaatcccagctacttgagaggctgaggtaggagaatcgcgtgaacctgggaggtggagattgccgtgagccgagatcaagccactgcactccagcctgggcggtagagcaagactccatctcaaaaaaaaakaaaaataaaataaaatgtagactatcttcatgagtttgggataggcagagatttcttgaacgggacactaaatatggtaaccatggaggagaaaaatggagaagctgaactaaaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgt

SEQ ID NO: 205095 - DNA, 601 bp, Human
ttttgggattgccctatttagcatctgctgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatayatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgag

SEQ ID NO: 205096 - DNA, 601 bp, Human
tgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgygtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagctt

SEQ ID NO: 205097 - DNA, 601 bp, Human
cctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtga

SEQ ID NO: 205098 - DNA, 601 bp, Human
atgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatayaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtgatactctgtctcaaaaaaaaaaaaaaatccttggggctagttatcttgattttattattatgatgatacacaagaaagaaaacaccaaacaagctgaaataattgaaaatactcacatccaacccaatttaatttatttcactggaatctatctagt

SEQ ID NO: 205099 - DNA, 601 bp, Human
tccagaatattcccttctcccggctttgcagaatgtagaccattaccatacaagttttgtaagccttttggaaaactagtgaattagtttcaagtgatctgtgatctggccctcatatgcctactcagagcaagcctagggttcctaaattccagtgggaaggggactgcaggtctcctgttgttagcagagattttctgagccctgctcttgtccttgcctcctcactcccttgatagaggagaaaacacgtgccatgattttttgttcctctttcactaacattttcttgtgcacacayctaaattttagttatcaacttcactctgaatctctcctccctcctttccaaagatacagcaaaacttgttctgttccaagtgcttggttgcgttttctgttggaagactaaccatgtctcccataaagcaatgggccacatggacataccctgaggcatttcacactggtaaaatcaggaggctgtcagaaaactaccaacagctaaagactcaccaatgaaagagctatgcaagaattcaaataacattcgtcaaatagttttgtgctttgatcctgctgggttttgttttgttttgct

SEQ ID NO: 205100 - DNA, 601 bp, Human
ctaataactagttaattttcaatttttctgattgtcttaaacatgtccttaaaaaaaaaaacagttggtctttgattcaatctccaaataaaaatcacaggtgaacttagttgatatgtctgttttactccacaagggatccccctatttttgttttttaaaccacatttatttgttgaagaaactggagtatttgtcctgtaaactgtcttacattctgaatttgactgttttcagggtaatctaatagctgatgaaagttcttgtttataggagaatcacagcttaaaaatgcagaagmaataataggaagctatctatttaaaaaaaaatccctaaggaaaggattgatctaggcaattatcatcaatggctgctaaaaccattaggtaaatggttgattgggaaattcatgatatcagaccgatatcacctgaaccctaatatcaatgatagcattgctaaaagtggggcaaccagatattgtgtgcctcctggtatcagtaggaagtgcacactatcaccagtgatgttgtcgtgcccccacaattgagcctctagttttaagaggagcttacagaaaacatggggaatagagaaa

SEQ ID NO: 205101 - DNA, 601 bp, Human
tcggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcytcggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaa

SEQ ID NO: 205102 - DNA, 601 bp, Human
ggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcttsggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaagt

SEQ ID NO: 205103 - DNA, 601 bp, Human
ttgtcattttttgtttttgttgcaattgttttgggcatcttcatcatggaatcttgcccaaagtaatttacagattcaatgctatttctatcaaactaccaatgacattgttcacagaattagaaaaaggctattctaaaattcatatggaatcaaaacagagcccgaatagccaaagcaatcctaagcaaaaagaacaaagctggaggcatcacattacccgatttcaaactatagtataaggctgtagtaacaaaaacagtgtggccggtacaactacggatacatagatcaatggaarcagcccagaaataaagctgcacaccaacaaccatctgatctttgataaagtctacaaaaacaagcaatgggtaaaggactgtggtgctgggataactggctagccatatgcagaagattgaaactggacccatcccttttatcatatacaaaaatcaactcaagatggattaaagatgtaaatgtaaaacctaaaactgtgaaaacccttgaagaaaacctaggaaataccattccagacataggccctgtactatattttgaagtcaggtaatgtgattctccagctttgttatttttg

SEQ ID NO: 205104 - DNA, 601 bp, Human
tggagtcacactctgtcacccaggctggagtgcagtggcgccatcccagcttgctgcaacctccgcctcctgggttcaagtgattctcctgcctcagcttcccaagtagctagaattacaggtgcgtgccgccacacctggctcatttttgtatttttagtagagactgggttttaccgtgttggccaggctggccttgaattcctgacctcaagtgatctgcctgccttggcctcccaaagtgctgggattacaggcatgagccaccacacaaggcctggatgtccagtttttctaacaygctctttgaaaagactgtcttctttcttttgtttacctttaaggtgctgaaagttttttttgtttttttttgttttttttgtttttttttcctgagacagagttttgctctgttgcccaggctggagtgtagtggcgtgatctctgctcactgcagcctccatctcccaggttcaagcaattctcctgcctcagcctcctgagtagctgggattacagccacacgctaccatacctggctaatttttatattcttagtagagacggggtttcaccacgttggccagcctggtctcaaact

SEQ ID NO: 205105 - DNA, 601 bp, Human
aatactggaactggtgataggagacaacgattttagtctgagctctgcccaatcatgttaccttgggaaagtcacaacaattatctggcttttgtttctcctcccattgaataagggagaatagctaataatctctaagatctattccaactgaaatagccttgttgttattcagtgttgataggacctcaaaaggtttagaaaacataaattagaaaagcaggggcaggtctctgatagtttattatatctgtcattgccaaagtgcctatttgcatgtaattctgagtgtactgaattstttttgtaatggtgacatgagctcaaaatatggctgggatgcagacgatttcatcactcttgttaacatggtacgtaagaatttacagtgctagcagaatgctttctgtttttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatg

SEQ ID NO: 205106 - DNA, 601 bp, Human
aaacatatttcctaagaagctattgtcatggtcactttgttctttatttcttacagtatcgggatgccctttacaagttcatggtggatactgccgtgcttttaggagctaacagttccagagcagagcatgacatgaagtcagtgctcagattggaaattaagatagctgaggtaagtcttcactgaaaatctctttctttcctttactttcttttcttttcctttactttcttttcctttccttttattaaaggcagtatatcctgaatgaaaatataaattgcaaacaaataatagcrttttgtgtcattgcccattgggcccaaggtagaactaatagcatcccctctaggaagtaacaaggactgtgacagaaaagctcctcattccttccacctccctggtttaagcccattcagtgtccatacgttgctcagctgtggccaaagaatagcagcagagagaccctctgaccgtttttcctggagaaactcatgtttggcttaaatagaagatagatgtttaataaatccttagtaatctggcttgaatggaaggttgcttttaatccagcccatgttttatgctatccccactca

SEQ ID NO: 205107 - DNA, 601 bp, Human
ccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacrtgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcattt

SEQ ID NO: 205108 - DNA, 601 bp, Human
tctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataatartaataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtt

SEQ ID NO: 205109 - DNA, 601 bp, Human
tcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagyttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggt

SEQ ID NO: 205110 - DNA, 601 bp, Human
ctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgyagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcat

SEQ ID NO: 205111 - DNA, 601 bp, Human
cgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttc

SEQ ID NO: 205112 - DNA, 601 bp, Human
aacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacayatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgt

SEQ ID NO: 205113 - DNA, 601 bp, Human
ttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgarggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctcta

SEQ ID NO: 205114 - DNA, 601 bp, Human
ggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctrgctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctatt

SEQ ID NO: 205115 - DNA, 601 bp, Human
tacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgttt

SEQ ID NO: 205116 - DNA, 601 bp, Human
ttgatcatagccatcctaacaggtagtgaagtgctatttcattatggtttgatttgcatttccctgatgattagtgatgaaaaccttttcataaacctgctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataayaatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgt

SEQ ID NO: 205117 - DNA, 601 bp, Human
tatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcraatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgagccactgcccatatacaaagcctggaatgtaacaaagagcccaccaagagttttgcctaggcttttcc

SEQ ID NO: 205118 - DNA, 601 bp, Human
gaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcaygtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgagccactgcccatatacaaagcctggaatgtaacaaagagcccaccaagagttttgcctaggcttttcctggatcttgaagcat

SEQ ID NO: 205119 - DNA, 601 bp, Human
caggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctcyagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttctttt

SEQ ID NO: 205120 - DNA, 601 bp, Human
aaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagccccaaaaaaaaaaaaaaaaaaaaaaaaaagccycggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttc

SEQ ID NO: 205121 - DNA, 601 bp, Human
taattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctayattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagc

SEQ ID NO: 205122 - DNA, 601 bp, Human
ttttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttyggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctga

SEQ ID NO: 205123 - DNA, 601 bp, Human
taaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttktttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgccc

SEQ ID NO: 205124 - DNA, 601 bp, Human
ttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgygatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctg

SEQ ID NO: 205125 - DNA, 601 bp, Human
cttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccrtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttgg

SEQ ID NO: 205126 - DNA, 601 bp, Human
ccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccrccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtatt

SEQ ID NO: 205127 - DNA, 601 bp, Human
ttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactrtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttt

SEQ ID NO: 205128 - DNA, 601 bp, Human
tgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccc

SEQ ID NO: 205129 - DNA, 601 bp, Human
attggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatrtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtg

SEQ ID NO: 205130 - DNA, 601 bp, Human
tcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcattttttttycccaagtttcctctaactgcctccctcactaaataacatgctccattatagtgtcttaaaactgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgaga

SEQ ID NO: 205131 - DNA, 601 bp, Human
tctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaaytgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccatttt

SEQ ID NO: 205132 - DNA, 601 bp, Human
gcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctrtaattatctcaaaattgtttgctttcttttttttgaaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagat

SEQ ID NO: 205133 - DNA, 601 bp, Human
aagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagktattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttccttt

SEQ ID NO: 205134 - DNA, 601 bp, Human
gtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaycaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttacttta

SEQ ID NO: 205135 - DNA, 601 bp, Human
tgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttwaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggc

SEQ ID NO: 205136 - DNA, 601 bp, Human
cctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttygatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctg

SEQ ID NO: 205137 - DNA, 601 bp, Human
gtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggaycattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttact

SEQ ID NO: 205138 - DNA, 601 bp, Human
gtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcac

SEQ ID NO: 205139 - DNA, 601 bp, Human
gttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaaygaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattat

SEQ ID NO: 205140 - DNA, 601 bp, Human
tgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttawactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgcca

SEQ ID NO: 205141 - DNA, 601 bp, Human
ttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttaygggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacc

SEQ ID NO: 205142 - DNA, 601 bp, Human
ttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgsgggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctc

SEQ ID NO: 205143 - DNA, 601 bp, Human
tcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatggkggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctca

SEQ ID NO: 205144 - DNA, 601 bp, Human
ctaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcatawaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaac

SEQ ID NO: 205145 - DNA, 601 bp, Human
aaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccmtatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaa

SEQ ID NO: 205146 - DNA, 601 bp, Human
atggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccrcctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacat

SEQ ID NO: 205147 - DNA, 601 bp, Human
taaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctcyaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggc

SEQ ID NO: 205148 - DNA, 601 bp, Human
atgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaa

SEQ ID NO: 205149 - DNA, 601 bp, Human
aaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatayctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacaga

SEQ ID NO: 205150 - DNA, 601 bp, Human
tgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcmtgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactg

SEQ ID NO: 205151 - DNA, 601 bp, Human
acaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccartagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcactgaatcaatctctctatatctcttaacattttttccttctcataggatttccagcaggagagctccagaagcctttcttttggggaacagaatatcctcggtgagtaaatgagtacaga

SEQ ID NO: 205152 - DNA, 601 bp, Human
gtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttaytgatgaagtaatttgtttattgggtctgtgagcatgttagtgtctatttgtttgtaccttaggctaggtcacagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgct

SEQ ID NO: 205153 - DNA, 601 bp, Human
ctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcayagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttcc

SEQ ID NO: 205154 - DNA, 601 bp, Human
ccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattaygtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaaccc

SEQ ID NO: 205155 - DNA, 601 bp, Human
ctcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttwtttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtga

SEQ ID NO: 205156 - DNA, 601 bp, Human
aaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttagttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccac

SEQ ID NO: 205157 - DNA, 601 bp, Human
tcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagcccygcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaag

SEQ ID NO: 205158 - DNA, 601 bp, Human
cttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggaktttgataccagcctgggaaacatacggagaccctgtctctacagaaaattttttaaaaaattagccgggtgtagtggtgcatgcctgtagtcccagctactcaggaggctgaggtggaagaattgtttgttgaaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagagg

SEQ ID NO: 205159 - DNA, 601 bp, Human
tcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccraagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgtta

SEQ ID NO: 205160 - DNA, 601 bp, Human
ggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttsttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaa

SEQ ID NO: 205161 - DNA, 601 bp, Human
tcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctytgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatt

SEQ ID NO: 205162 - DNA, 601 bp, Human
aatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccrctgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataatttt

SEQ ID NO: 205163 - DNA, 601 bp, Human
ggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagaatatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcat

SEQ ID NO: 205164 - DNA, 601 bp, Human
gggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttctyctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaact

SEQ ID NO: 205165 - DNA, 601 bp, Human
ctttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcartaaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcct

SEQ ID NO: 205166 - DNA, 601 bp, Human
tgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggmaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgt

SEQ ID NO: 205167 - DNA, 601 bp, Human
tattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgkaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctc

SEQ ID NO: 205168 - DNA, 601 bp, Human
acaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaamccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagcc

SEQ ID NO: 205169 - DNA, 601 bp, Human
taatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctcckcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaaggg

SEQ ID NO: 205170 - DNA, 601 bp, Human
atgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaaacagaggttgcaatcctagtctctgataaaacagactttawtccaacaaagatcaaaagagacaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctac

SEQ ID NO: 205171 - DNA, 601 bp, Human
gcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaasaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaa

SEQ ID NO: 205172 - DNA, 601 bp, Human
ctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagwgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggat

SEQ ID NO: 205173 - DNA, 601 bp, Human; identical to SEQ ID NO: 38895

SEQ ID NO: 205174 - DNA, 601 bp, Human; identical to SEQ ID NO: 38896

SEQ ID NO: 205175 - DNA, 601 bp, Human; identical to SEQ ID NO: 38897

SEQ ID NO: 205176 - DNA, 601 bp, Human; identical to SEQ ID NO: 38898

SEQ ID NO: 205177 - DNA, 601 bp, Human
atgcagctggaggcccttatcttaagcaaattaatgcaggaacagaaaaacaaatacagcatgttttcacttataagtgaaacattggatacttatggacataaagatcagaacaatagaaactggggatgactagagggaggaggaatgcagggaggaagtgggggagggcagaaaacctaattattgggtactatgtccagtacctgggccaatcgtaccccaaacctcagcatcacccaagatacccaggtaacaaacctgtatgtgtatctcctgaatataaaataaaaattggggraaaaaaagggtcatgaaagctttgctttgtaagttaggttttcccaaagtgtccaggcctaaaaccctgtgcttgatttctctactacatggaggcacttcacttggttcctactacacaaagataaacaaggcacagtccgtgtcctaaaatattacagcctagtactttctcacaacaccaggctgtctcctaagaaggttgagtaggttctaatgagtgaaataatacctatcttatttttaaaagtattgaagtgaacggtagactgtaatgtgatagaaaacaactgcttcacag

SEQ ID NO: 205178 - DNA, 601 bp, Human
tgctggcaaaggctgcagagaaaagggagcacttataaactgttggtaggagggtaaattagttcagccactgtggaaatcaacttggagatttctcaaaaaacttaaaacagacctaccatttgacccagcaatcccattactgggtatatatccaaaagaagacaaatctttctaacaaaaagacacatgcacctgcatgttcatcgcagcattattcacaatagcaaagacatgaaatcattctaagtacccactaacagtggactgaataaagagaatgtggcacatatacaccatggaacgagatcatgtcctttgcaggaacatggatgcagctggaggcccttatcttaagcaaattaatgcaggaacagaaaaacaaatacagcatgttttcacttataagtgaaacattggatacttatggacataaagatcagaacaatagaaactggggatgactagagggaggaggaatgcagggaggaagtgggggagggcagaaaacctaattattgggtactatgtccagtacctgggccaatcgtaccccaaacctcagcatcacccaagatacccaggtaacaaacctgtatgt

SEQ ID NO: 205179 - DNA, 601 bp, Human
agaatggctattactaaaaagtcaaaaaacagctgatgctggcaaaggctgcagagaaaagggagcacttataaactgttggtaggagggtaaattagttcagccactgtggaaatcaacttggagatttctcaaaaaacttaaaacagacctaccatttgacccagcaatcccattactgggtatatatccaaaagaagacaaatctttctaacaaaaagacacatgcacctgcatgttcatcgcagcattattcacaatagcaaagacatgaaatcattctaagtacccactaacagtggactgaataaagagaatgtggcacatatacaccatggaacgagatcatgtcctttgcaggaacatggatgcagctggaggcccttatcttaagcaaattaatgcaggaacagaaaaacaaatacagcatgttttcacttataagtgaaacattggatacttatggacataaagatcagaacaatagaaactggggatgactagagggaggaggaatgcagggaggaagtgggggagggcagaaaacctaattattgggtactatgtccagtacctgggccaatcgtaccccaaacctcag

SEQ ID NO: 205180 - DNA, 601 bp, Human
gtaactaattcaaatttaaatttgaatggacatatttgcctagcggtcaccatattggacagtgcggtgaatctatattgattaaaatggtcatgaccatataatagccaaaaaacaagtgaaaaaatgctccacatcactaatcatcagaggaatgcaaatcaaaaccacaatgagataccatctcatacaagtcagaatggctattactaaaaagtcaaaaaacagctgatgctggcaaaggctgcagagaaaagggagcacttataaactgttggtaggagggtaaattagttcagcyactgtggaaatcaacttggagatttctcaaaaaacttaaaacagacctaccatttgacccagcaatcccattactgggtatatatccaaaagaagacaaatctttctaacaaaaagacacatgcacctgcatgttcatcgcagcattattcacaatagcaaagacatgaaatcattctaagtacccactaacagtggactgaataaagagaatgtggcacatatacaccatggaacgagatcatgtcctttgcaggaacatggatgcagctggaggcccttatcttaagcaaattaatgc

SEQ ID NO: 205181 - DNA, 601 bp, Human
tgctaatttcttaggaagggcactgcatttgatcatgagaaataggatgtgatgaatttggcaagtaaagaataaaaagatagacctgtagatgccatattcattaaaaaacaaaacaccagtggaggtgttctacgtacttgtgatttgcccatatctgtgaggggtgtggctacctctctgtggtttggctgtattgatggagatatggatggctcattgctctttcattctcttaccacactgaataatagtatattttgcaatggtggaaatcttctgtgctgtccaccagacacayggttgttgagttctgaaaatatgaacaatgtggctgagaaacctgaatgtttaatggtatttaattgtaactaattcaaatttaaatttgaatggacatatttgcctagcggtcaccatattggacagtgcggtgaatctatattgattaaaatggtcatgaccatataatagccaaaaaacaagtgaaaaaatgctccacatcactaatcatcagaggaatgcaaatcaaaaccacaatgagataccatctcatacaagtcagaatggctattactaaaaagtcaaaaaacagctgatg

SEQ ID NO: 205182 - DNA, 601 bp, Human
tttgcctttagtatttctttctaggaaagatttcaaatatagaaaacacttcccagaaaatgacaattattttaaggaagaaaaaaatattcaaagctattcctttcagctttttgataatttaagaccttctgaagattcaacagaaaatattaaggagattaagcgacctaactgtcttcttcaaaattctacatggacctaagatgccatataggcagtcagtctgctcttcctattgtgatattggaggacatgttctgtgcagcccttgctgagccttgggaggaggatggcacaytggccacagttggaaaggtagcttccttctagttagctggggaaggggcttggggtagtggttataagacttgggtttgtgcttgtgaaaacacatttttctgtttcttagattgattggattgacaataaacttccctcaacactgagaataaatccaggagaagataatttctcctaagggtaagaatgctaatttcttaggaagggcactgcatttgatcatgagaaataggatgtgatgaatttggcaagtaaagaataaaaagatagacctgtagatgccatattcattaaaaaa

SEQ ID NO: 205183 - DNA, 601 bp, Human
tctgctatctataaaggaaattacatacaagagactttttgtttgactgcgtttcaaaattctgttatctttgtagcaccacttttaggagcaagattttataaataaatgctgtgaaaaacttgtaaggcctcctggtttctattgtagctgttagcacctcaatctgttgtctgttacttgcttattttccttcaaggccttggggaattcatatttccatcctccagttatggtgcatttatttaataaattaagtagatgtatctacctagcaactgtaagtatttaataaatgtcycttgaatgaatgattcagtggtgttaccaatggtagcatggatagctaaatatgagaccttcaggttgggtactcaatgtgcatagtcttcttaccaaaatgtaatcaagtttcaaaggctgcagctacttactctaaattaaagaaaccattaaacttcttttgaacaaacaaagcaattatttcctgctctatatttgtagcttatgataatgcattttaaatagagcctgttgagtgtgttttttaccggttatttttcttggttttaacacttcattgtgtgcaaaagcctcttag

SEQ ID NO: 205184 - DNA, 601 bp, Human
aagattgtattcaataaaagggtaagtttagtttcttcaagttaatgctattagcaaatttcagaagtgaaatttgaccccagactgttggtttctactacttcataattagcctaatcgatatttaacacaattaaataacagaattatgagtaaagtgtaggaaacacagagaagggagtggttttcttcagattggtttataaagagcaattgagaggattaagtaccaaaagcagttgattataaaggaaggcctaattgacattgtaactagatgacactgaggatttctgtgaaktttgtgattggtaggtttagcaaagggctgtgcatgtgagtgtctcttatctaaataatcttcactgtcatttccaactcaatttctgctatctataaaggaaattacatacaagagactttttgtttgactgcgtttcaaaattctgttatctttgtagcaccacttttaggagcaagattttataaataaatgctgtgaaaaacttgtaaggcctcctggtttctattgtagctgttagcacctcaatctgttgtctgttacttgcttattttccttcaaggccttggggaattcata

SEQ ID NO: 205185 - DNA, 601 bp, Human
cttttgccagaagataaaaatcatgtaagagttaattctctatcaggaagaggacaaaaaaattccagcagacctgttttatgttttataactccatgatctgcatacgtccctgagctctttcataagtctatctgaaacttgcactgacccaaacaccacatcacatttaaatggccttgactttgagtcttcctaattttctctaatgttgccaaattttctttttcaattccttcatcctccaactttttcccactaataagttcttctttcttcatcttacagtgatttaagtatyttatatctccagccatctcttcttcctcttcttctgaagtcacttctattttcccattctgacccatgggtagtggttgatctagcatctcaaacatccaggtgcttaggaaggttatataatctgcagagttcacatatcaaccacttcaattgctgacgaaggtaattgttgttctcagtatcttctggacgttccagaactgatgtcagatttgggtcatcacagtccacaaaccatattggtgaaaaagatggataggattcttggaatctctaggcacgagaagaggctcaaccc

SEQ ID NO: 205186 - DNA, 601 bp, Human
gaggatccctatggtctgaatttgaacctgtaaccactccctttggctccctgctttcagttgcttgctttcttttcttcttccagttgatccagaatttcttggttttgttgtttctccagatccttcaggttagcagatgatgcagggccctccccattgacaaaggatgtagactcagaggcaagacaattgagctgttgaagagttgtcctgggctcttgatcaatgagaaagtcttggtttcatccatgagattgggaccaatgtcagcatcatgattctgaggtgccgccatgcwagtgagactggcaccaggggaagagacaccaccagctaacatggtgtcatgagcagacagttgtagaggagaaagcatggtctttgcacatatcctcaggtgaatggcaaccaccagaagtggttgtctcaggattgctgccatttttcattttctccttttttgctcttgtacctacaccagagttgtttgtatgctgatattctctcaatgttttcttggccacagccaatttgctctgtagggtttcttcagacatcacaggcagggtgggaggtggggttggggccatatcagcac

SEQ ID NO: 205187 - DNA, 601 bp, Human
gtgcacctccacctgctcctcccagagctcagccttctgctctagctccagcagcctctcctcctgctctcggttcaggagactcaagccctcattgtcttgcacctgggcttggagctgtcctgccagaccctccagctccttccgcaggtgctcggcctccacttatagctgctgctccacctcagagggccctgctgggggctccaggagcaggggttcagcgatctgttccctcagtttggccaagctggtctccagctcctgtacccgagtcatgctgtgctccttctcctccctyaatgtgtgcacctgctctgacatcggctgcatcctctgctaccgcatggccctccctcctttcagattttcagtatattggtctttctccatctgtagctgtttcagcaactccataacctgccccaggtgtgcttccagctgtgcctgctcctccatggcctgctgtaactgctggttagcatcagggggttcacactggcttgaggactattgaagcaggagcttggcctctccagcttcttttgcagatcctccaagttgagctggattcctgacttctctgtcactaggactcaaa

SEQ ID NO: 205188 - DNA, 601 bp, Human
tcagcttcatgaagccagtctgcaacttggccagctgctctttgagctcaccattctggaagactgcatgactgatggtggtgaggtcattctgcatggtctccagggtttgcctgtgcacctccacctgctcctcccagagctcagccttctgctctagctccagcagcctctcctcctgctctcggttcaggagactcaagccctcattgtcttgcacctgggcttggagctgtcctgccagaccctccagctccttccgcaggtgctcggcctccacttatagctgctgctccacctsagagggccctgctgggggctccaggagcaggggttcagcgatctgttccctcagtttggccaagctggtctccagctcctgtacccgagtcatgctgtgctccttctcctccctcaatgtgtgcacctgctctgacatcggctgcatcctctgctaccgcatggccctccctcctttcagattttcagtatattggtctttctccatctgtagctgtttcagcaactccataacctgccccaggtgtgcttccagctgtgcctgctcctccatggcctgctgtaactgctggttagcatc

SEQ ID NO: 205189 - DNA, 601 bp, Human
agctcacccagcttctcgctcggctctttcttgatgtgctgctccgactgtggtgtgctggtgatctccatgttctcattgttcagcttcatgaagccagtctgcaacttggccagctgctctttgagctcaccattctggaagactgcatgactgatggtggtgaggtcattctgcatggtctccagggtttgcctgtgcacctccacctgctcctcccagagctcagccttctgctctagctccagcagcctctcctcctgctctcggttcaggagactcaagccctcattgtcttgcrcctgggcttggagctgtcctgccagaccctccagctccttccgcaggtgctcggcctccacttatagctgctgctccacctcagagggccctgctgggggctccaggagcaggggttcagcgatctgttccctcagtttggccaagctggtctccagctcctgtacccgagtcatgctgtgctccttctcctccctcaatgtgtgcacctgctctgacatcggctgcatcctctgctaccgcatggccctccctcctttcagattttcagtatattggtctttctccatctgtagctgtt

SEQ ID NO: 205190 - DNA, 601 bp, Human
gcctcttggctcttcagctctaccatctccttcagctcacccagcttctcgctcggctctttcttgatgtgctgctccgactgtggtgtgctggtgatctccatgttctcattgttcagcttcatgaagccagtctgcaacttggccagctgctctttgagctcaccattctggaagactgcatgactgatggtggtgaggtcattctgcatggtctccagggtttgcctgtgcacctccacctgctcctcccagagctcagccttctgctctagctccagcagcctctcctcctgctctyggttcaggagactcaagccctcattgtcttgcacctgggcttggagctgtcctgccagaccctccagctccttccgcaggtgctcggcctccacttatagctgctgctccacctcagagggccctgctgggggctccaggagcaggggttcagcgatctgttccctcagtttggccaagctggtctccagctcctgtacccgagtcatgctgtgctccttctcctccctcaatgtgtgcacctgctctgacatcggctgcatcctctgctaccgcatggccctccctcctttcagatttt

SEQ ID NO: 205191 - DNA, 601 bp, Human
gaagcgcctcctcctcactgtccagtccatctccttccccatggagagccatgagggtcagctgggcctgtggctgctacttctgctggctggtagcttccaggtgctcctgggtctcctgcaacccttggcaggccatcttggccacgactttgccctgagcttcctcctgctgcagctggtctatgagctgggtctgcagcagtaactgcttgtggagctccttctcatagggcacctgctgataggtggccacatactgctgcaggtgacccaggtactgatctcactactgctgtaractctgagcctcttggctcttcagctctaccatctccttcagctcacccagcttctcgctcggctctttcttgatgtgctgctccgactgtggtgtgctggtgatctccatgttctcattgttcagcttcatgaagccagtctgcaacttggccagctgctctttgagctcaccattctggaagactgcatgactgatggtggtgaggtcattctgcatggtctccagggtttgcctgtgcacctccacctgctcctcccagagctcagccttctgctctagctccagcagcctctcctc

SEQ ID NO: 205192 - DNA, 601 bp, Human; identical to SEQ ID NO: 38899

SEQ ID NO: 205193 - DNA, 601 bp, Human; identical to SEQ ID NO: 38900

SEQ ID NO: 205194 - DNA, 601 bp, Human; identical to SEQ ID NO: 38901

SEQ ID NO: 205195 - DNA, 601 bp, Human; identical to SEQ ID NO: 38902

SEQ ID NO: 205196 - DNA, 601 bp, Human; identical to SEQ ID NO: 38903

SEQ ID NO: 205197 - DNA, 601 bp, Human; identical to SEQ ID NO: 38904

SEQ ID NO: 205198 - DNA, 601 bp, Human; identical to SEQ ID NO: 38905

SEQ ID NO: 205199 - DNA, 601 bp, Human; identical to SEQ ID NO: 38906

SEQ ID NO: 205200 - DNA, 601 bp, Human; identical to SEQ ID NO: 38907

SEQ ID NO: 205201 - DNA, 601 bp, Human; identical to SEQ ID NO: 38908

SEQ ID NO: 205202 - DNA, 601 bp, Human; identical to SEQ ID NO: 38909

SEQ ID NO: 205203 - DNA, 601 bp, Human; identical to SEQ ID NO: 38910

SEQ ID NO: 205204 - DNA, 601 bp, Human; identical to SEQ ID NO: 38911

SEQ ID NO: 205205 - DNA, 601 bp, Human; identical to SEQ ID NO: 38912

SEQ ID NO: 205206 - DNA, 601 bp, Human
tttgatcatgatccagagtaaaaaatgcatttcacaggccaactcaggatacacacacacacacacacacacactcccctactatctatcagactctgatattttctattctattattctctatcttctttcatttaaaaatgtattgacttactaaagaggtttttcagcttaaaaatttttatttagaccaattcatggggtactcatgcaattttgttacatgtatacaatgcatagtgatcaagtcagggtgtttagggtgtttattactcgagtacaatacatgttttgaaactayagtcaccctactctgttgcaaacgttgaatatattcttactgtatgtttgtatcctttaatccacttttctttatgcgctcctctccccaccactcacccttcccagtctctgttatctttccactctctgtctctatgtgatcaaaatttttagctcccacatatatgtgagaacgtgtgatatttatcgttttgggtctggcttatttcactaagataatgaccttcagtcccatccattttggtgcaaatgacatgattttatccttttttatggccaaatagcatttaccagccat

SEQ ID NO: 205207 - DNA, 601 bp, Human
tttctgttctttagtggttactcacactcattttctattgtactccaggtttggtacatatgtttgtgttttagcctttggagatacttcttactttctagggaactcagcaatcactgaaaactgttgtaattgtattcatttagaaacttataacaaataattataataagtaacttaacaaaattacaacaggtaatttatcttgcattttagagagagtatcttggctacctgggctatgatgtagctggaattagaaatccaaaacactagcacacttgaagtttcttatgggctraagctgagatttctttcttcttgttacaatgcagatttggccattcctttcgtttttccttactccccctctctcttcctgcttttatatacctatatattgtctattattatatacttaacactgagcttaacactgggaacaagatatagtccctagaaactccacagagaggcgtctaggtgtaaaaggagaaatagcttcactttctggaaggcattctgatgcaatcctatattgttttgctaatttgaaaaaaacagctatcagccacagtcatctaatgatgttggattacat

SEQ ID NO: 205208 - DNA, 601 bp, Human
ctgccttcccaggaggttaagcatcctaagtcacaggatgaaacaggaggttggcacaagatacaggtaacagagagcttgctgataaattaggtttcagtaaagaaactggcccaaatccaccacaaccaagatggcgatgaaagtgaactcttgtcatcctcattgctcattatacgctaattataattcattagcatgctaaaagacactcccaccagcaccatgacagtttacaaatgccatggcaatatccagaagttaccctatatagtctaaaaaggggaggaaccctcaattmtgggaattgcctacccctttccctgaaaattcatgaataatccactccttgtttagcatataatcaagaaataattgtaggtattctaagcagtccatgccactgctctgcctatgcagtagctatttttttatttcttactttcttaataaatttgctttcactttattccatggacttgccccaaattctttcttgcacaaggtccaagaaccctctcttggggtctggatcaggacccctttctggtaacatactgatctattttaaattgtccttaccatcttatgttgtgtcttc

SEQ ID NO: 205209 - DNA, 601 bp, Human
attttgactaatgttaattgacaatctctattagcatgtgagtttagttcacattaatttactgcacatatttgtcagaggtgtttgaaccagagtgactccctcttgaaaaggggctgggtaaaataaggctgcgacctactgggctgccttcccaggaggttaagcatcctaagtcacaggatgaaacaggaggttggcacaagatacaggtaacagagagcttgctgataaattaggtttcagtaaagaaactggcccaaatccaccacaaccaagatggcgatgaaagtgaactctygtcatcctcattgctcattatacgctaattataattcattagcatgctaaaagacactcccaccagcaccatgacagtttacaaatgccatggcaatatccagaagttaccctatatagtctaaaaaggggaggaaccctcaattctgggaattgcctacccctttccctgaaaattcatgaataatccactccttgtttagcatataatcaagaaataattgtaggtattctaagcagtccatgccactgctctgcctatgcagtagctatttttttatttcttactttcttaataaat

SEQ ID NO: 205210 - DNA, 601 bp, Human
aaatgccttctattgatgtgaatagaaattgctgttctgatgagaattaatggaatcataataaacttgacttattttaaatgttcacagtgttccatttatgccccacagtctgctgcctaattctaactaggtcaaaatttgcaaatccaaaggcctaatgagcaaccttcaatttataggtcaccaggaccatcacaagggttaagttaaaaaataggtaattattgcaaaaacttggcttacaagatcaaagggtaacatgaagcaatagaaggagaaattgatgttaaaaaaactrttaggataagtatactagtaactgacatatgcaaattatctaaaaagataagtaaagaggctgcttttaaaagcattttcattgcaagggtggcaacctgtgtccctgacagttggtaacaggattgttggagctttggttttgagtgagaatgcttcagtctaaatgagcagagcagagctgatggggtaatatttatagtcagagaatgtgagttgtatgataacaaggctgtggaatttatcgaaactaggtttgggcctagaaaatgatcacttttagtagtttttctgtgagtga

SEQ ID NO: 205211 - DNA, 601 bp, Human
tgtaaaattgagaaggtggattacctaaatttttctagcactatggtatagtaattctgattccttccttacatcaactaaagtcaataattcccatgatgccttgtttacttctctttttttcaaagaaaagatacattagggactgggactgtggatttgttaaaaaatttgtgcacagtgggaaatttatgtcagaaaatacataaaattgggatatatgtggacaaaaatacattgggaacatttttaagtatcacataatcttaggtacttacttgtgttctccttttgaactaartatttgcattctttctcacattttacagtctaaagaaggatgttattcactcaatataaataaaaatgccttctattgatgtgaatagaaattgctgttctgatgagaattaatggaatcataataaacttgacttattttaaatgttcacagtgttccatttatgccccacagtctgctgcctaattctaactaggtcaaaatttgcaaatccaaaggcctaatgagcaaccttcaatttataggtcaccaggaccatcacaagggttaagttaaaaaataggtaattattgcaaaaac

SEQ ID NO: 205212 - DNA, 601 bp, Human
tctttgctctgggtttttttttttgttttgtttgtttgtttgtttgtttttgttatattccaagggtgaccctctaggaattgtaatataaatatcctccctcttcctctccctttcccccctcctccctttccttctctctctctgccattgtctgatctcagctatgaggtatctaggacatcctgaataaatattttcatctacctaagtctcatcatctttatctgtaaaattgagaaggtggattacctaaatttttctagcactatggtatagtaattctgattccttccttacmtcaactaaagtcaataattcccatgatgccttgtttacttctctttttttcaaagaaaagatacattagggactgggactgtggatttgttaaaaaatttgtgcacagtgggaaatttatgtcagaaaatacataaaattgggatatatgtggacaaaaatacattgggaacatttttaagtatcacataatcttaggtacttacttgtgttctccttttgaactaaatatttgcattctttctcacattttacagtctaaagaaggatgttattcactcaatataaataaaaatgcctt

SEQ ID NO: 205213 - DNA, 601 bp, Human
ctccttctgaactctcccctgtcatgcttctcactgaccttcacttccttctgatccactgattctttgctctgggtttttttttttgttttgtttgtttgtttgtttgtttttgttatattccaagggtgaccctctaggaattgtaatataaatatcctccctcttcctctccctttcccccctcctccctttccttctctctctctgccattgtctgatctcagctatgaggtatctaggacatcctgaataaatattttcatctacctaagtctcatcatctttatctgtaaaattragaaggtggattacctaaatttttctagcactatggtatagtaattctgattccttccttacatcaactaaagtcaataattcccatgatgccttgtttacttctctttttttcaaagaaaagatacattagggactgggactgtggatttgttaaaaaatttgtgcacagtgggaaatttatgtcagaaaatacataaaattgggatatatgtggacaaaaatacattgggaacatttttaagtatcacataatcttaggtacttacttgtgttctccttttgaactaaatatttgcat

SEQ ID NO: 205214 - DNA, 601 bp, Human
atctccttctgaactctcccctgtcatgcttctcactgaccttcacttccttctgatccactgattctttgctctgggtttttttttttgttttgtttgtttgtttgtttgtttttgttatattccaagggtgaccctctaggaattgtaatataaatatcctccctcttcctctccctttcccccctcctccctttccttctctctctctgccattgtctgatctcagctatgaggtatctaggacatcctgaataaatattttcatctacctaagtctcatcatctttatctgtaaaaytgagaaggtggattacctaaatttttctagcactatggtatagtaattctgattccttccttacatcaactaaagtcaataattcccatgatgccttgtttacttctctttttttcaaagaaaagatacattagggactgggactgtggatttgttaaaaaatttgtgcacagtgggaaatttatgtcagaaaatacataaaattgggatatatgtggacaaaaatacattgggaacatttttaagtatcacataatcttaggtacttacttgtgttctccttttgaactaaatatttgc

SEQ ID NO: 205215 - DNA, 601 bp, Human
atgttaagacatagagccttgccatcactttagaaagttctctcaattcttttcccagtcaatccttactcaaatgcgccagaggcaatcacctgttctaatttttttctaccgtggataagtttgcctgttttagaatttcacataaatgaaatcgtacagtatatatgcttccgtataagatgtcttttactcagtatggttttgagagttatttatgttgtgtattggtaatttattcctttttattgctgcatagtattcattgtatctttataccacagtttgtttatttattcayctatggatgaatacctagcctgcctcaagtttttggttttgatgaatagagcttctgtgaaaattcttgaacaagttttattctgtgaacatatattttcattacttttgggtaaaatacctacattggaatttttgagttgtagggtagttgtgtttagttgtaaaataaactgtcagatctttttccaatatggttttatcatttcacattccctctaacaatatgtgagttccagtaaccccatgttatcctaacacctggcattgtcattatcccagcacttggtattgtcagtct

SEQ ID NO: 205216 - DNA, 601 bp, Human
tcaaaattactttagctattcggggtcttttgtggttccatacaaatttttggatttttttctgttcctgtaaaaaaatcattgagattttgatagggattgcattgaatttatagatcattgtgagtagttgggacattttaacaatattaattattctagcccttgaatacagatgtctttcaatttattagtttctactttaattttttatcagcattttgcagttttcagtgtacaagtctcacacccctttggttaagtttattccaaatattttattctttttgatgcttaattwccttttcagagagtttattgttagtgtgtagaaatgctactgatttttgtatcatttaataaattttgacaaatgcatatacctgtgtaacaaaacacatgttaagacatagagccttgccatcactttagaaagttctctcaattcttttcccagtcaatccttactcaaatgcgccagaggcaatcacctgttctaatttttttctaccgtggataagtttgcctgttttagaatttcacataaatgaaatcgtacagtatatatgcttccgtataagatgtcttttactcagtatgg

SEQ ID NO: 205217 - DNA, 601 bp, Human
gactatctttcctcattgcatatccttagcacccttggacaggcagttgaccatctatgtattcatttatttctgggctctctattttgtttcattggaccatatgtgtgtttttatgccagtttcatactgttttgattatggtagctctgtgatatattttgaaatcaggaagtgggatgcctttggctttgtcctttttgctcaaaattactttagctattcggggtcttttgtggttccatacaaatttttggatttttttctgttcctgtaaaaaaatcattgagattttgatagrgattgcattgaatttatagatcattgtgagtagttgggacattttaacaatattaattattctagcccttgaatacagatgtctttcaatttattagtttctactttaattttttatcagcattttgcagttttcagtgtacaagtctcacacccctttggttaagtttattccaaatattttattctttttgatgcttaatttccttttcagagagtttattgttagtgtgtagaaatgctactgatttttgtatcatttaataaattttgacaaatgcatatacctgtgtaacaaaac

SEQ ID NO: 205218 - DNA, 601 bp, Human
acagtgaacactcacatgcccactgcctagattctaccattaacattttactatgcttgcttcgtcacatattcctccacttatttatcaataaaaccttcttattttttggatgtatttcaaaataatttctagacagccagaaactttctcctaaaaacagtacttcagaatatatatgttaactggagttcagtatttgtttagagttatgttttattttgaatatacagttaaagcactaatgaggccgggcatggcggctcacacctgtaatcccagtgctttggtaggctgaggygggtggatcacttgaggttgggagtttgagaccagtctggccaacatggtgaaaccccgtgtctacttaaaatacaaaaagtagccgggtatggtggtgggtgtctgtaatcccagctactcaggaaggctgaggcaggagaatcgcttgaacccgggaggcggaggttacagtgagctgagatggtgccactgcactctagccggggtgacagagtaagaccctgtctcaaaaaaaaaaaaaaaaaaaaaaaaaaaaaggcactaatgttaagtaagaccatttggtgaatttaaagaa

SEQ ID NO: 205219 - DNA, 601 bp, Human
ttattttggtcaccggttttggacctgtgggtctctttaaattaaggaaatttattaaacctgacattacccaagagtgaagagaaacaagattctctcccaacatggtcaattccatgataagtgttgggattacttcccctccaaagtcactcaaaagtttgtcctactttaacaggaacaaacataagaattactttctcccattttcttttttatgattttaaaaaataacaatcaaatgtaaaattttggcatggattttccaaatctcaagggtttggcttgaacaatttttttgatattaaatagtctgctatgttaattggaagttttctgccctgatgctttgagatttattttaggattcttttctcagtcacatcttacacctagacatgcataaccaaaggtaagatttgtaatttaattagatgacctcttatggatttcctaagattagcttaattagtcaagtgtgtccatctctaatatctacatcccagtcagatagatcttttcaaagagattctatctggctggattaacacatgaagtatctaattattagctatacaatgcatcaactgtataacacatg

SEQ ID NO: 205220 - DNA, 601 bp, Human
ttacctgatttattttggtcaccggttttggacctgtgggtctctttaaattaaggaaatttattaaacctgacattacccaagagtgaagagaaacaagattctctcccaacatggtcaattccatgataagtgttgggattacttcccctccaaagtcactcaaaagtttgtcctactttaacaggaacaaacataagaattactttctcccattttcttttttatgattttaaaaaataacaatcaaatgtaaaattttggcatggattttccaaatctcaagggtttggcttgaacwattttttttatattaaatagtctgctatgttaattggaagttttctgccctgatgctttgagatttattttaggattcttttctcagtcacatcttacacctagacatgcataaccaaaggtaagatttgtaatttaattagatgacctcttatggatttcctaagattagcttaattagtcaagtgtgtccatctctaatatctacatcccagtcagatagatcttttcaaagagattctatctggctggattaacacatgaagtatctaattattagctatacaatgcatcaactgta

SEQ ID NO: 205221 - DNA, 601 bp, Human
aatcctgccctagtcgagcttttatttcttatctaggtatgccacatataacattagcactttgggtaactgggcactaagctttgaacaagggtggtcttttcttgtaaaaatagtttgagattttaagatcttcaaatagtaagaagttgaggtttacaaagaaagaaagaaactgcagttgaagttaatattcaaataaaaacagatctagaaagaaattactcattttgaaattcaataccttttgaaggacataggactcttttttttttttaacctagttccttgttataggaasagaaaaaataatgaactctttggtagggcttgaaaaccactatgccaagagaataaaaatgttaccactgtataatttttttctagcagtcttccttggacttactaatatcatagtgaacttgatgtcaaagagaaccaccttgaagaagtctggaattaattttatggattgcattttaacttttcaaattccaatttataatttcctattacctgatttattttggtcaccggttttggacctgtgggtctctttaaattaaggaaatttattaaacctgacattacccaagagtga

SEQ ID NO: 205222 - DNA, 601 bp, Human
agattttgtgtgtcccaactagctatttcagcatcttgtacagacacagaaaaggagtactttttacggaatcctgccctagtcgagcttttatttcttatctaggtatgccacatataacattagcactttgggtaactgggcactaagctttgaacaagggtggtcttttcttgtaaaaatagtttgagattttaagatcttcaaatagtaagaagttgaggtttacaaagaaagaaagaaactgcagttgaagttaatattcaaataaaaacagatctagaaagaaattactcatttkgaaattcaataccttttgaaggacataggactcttttttttttttaacctagttccttgttataggaacagaaaaaataatgaactctttggtagggcttgaaaaccactatgccaagagaataaaaatgttaccactgtataatttttttctagcagtcttccttggacttactaatatcatagtgaacttgatgtcaaagagaaccaccttgaagaagtctggaattaattttatggattgcattttaacttttcaaattccaatttataatttcctattacctgatttattttggtc

SEQ ID NO: 205223 - DNA, 601 bp, Human
ggttaggtgtattaactgcatttttggcttgcaatattttcccgataggtttattgtgatgtaacctcatcagaagtcaaagacatctgtatatatatttcataattcttgtgcacttaggcatactatctggtaattctacatagctctgataacttggtctgtatcaagcatttccactgaatcctttaaaaatgtcatttatataaagaacgtctccaggttttgttacagagggacattaagattttgtgtgtcccaactagctatttcagcatcttgtacagacacagaaaaggartactttttacggaatcctgccctagtcgagcttttatttcttatctaggtatgccacatataacattagcactttgggtaactgggcactaagctttgaacaagggtggtcttttcttgtaaaaatagtttgagattttaagatcttcaaatagtaagaagttgaggtttacaaagaaagaaagaaactgcagttgaagttaatattcaaataaaaacagatctagaaagaaattactcattttgaaattcaataccttttgaaggacataggactcttttttttttttaacctagttcc

SEQ ID NO: 205224 - DNA, 601 bp, Human
aaagaacatataacatttacttagctatccagagagtccttaacatactatggtttgattttatgatggcataaaagcaatatccattcagtagaaaccatactttgcatactcatacaaccattctgcttttcacttttagtatggtattcaataaattacatgagatattcaacaatttattagaaactaggctttgtggtagatgattttgctgaactgtagactaacataattgttctgtgcacatttaagttaggttaggctaagctatgatgtttggtaggttaggtgtattaaytgcatttttggcttgcaatattttcccgataggtttattgtgatgtaacctcatcagaagtcaaagacatctgtatatatatttcataattcttgtgcacttaggcatactatctggtaattctacatagctctgataacttggtctgtatcaagcatttccactgaatcctttaaaaatgtcatttatataaagaacgtctccaggttttgttacagagggacattaagattttgtgtgtcccaactagctatttcagcatcttgtacagacacagaaaaggagtactttttacggaat

SEQ ID NO: 205225 - DNA, 601 bp, Human
actgttgattgtaatgggcaactgatctagaaatttggtattgaagaaaatcaagtatgctcagaaatgtacttgataaaatttctgtacttgaacaattgcaaatgaagaggctgaggtcattacagaccagataggaacaggatgagaaaagaatatgataaggattagtaaagaacatataacatttacttagctatccagagagtccttaacatactatggtttgattttatgatggcataaaagcaatatccattcagtagaaaccatactttgcatactcatacaaccattctgyttttcacttttagtatggtattcaataaattacatgagatattcaacaatttattagaaactaggctttgtggtagatgattttgctgaactgtagactaacataattgttctgtgcacatttaagttaggttaggctaagctatgatgtttggtaggttaggtgtattaactgcatttttggcttgcaatattttcccgataggtttattgtgatgtaacctcatcagaagtcaaagacatctgtatatatatttcataattcttgtgcacttaggcatactatctggtaattctacat

SEQ ID NO: 205226 - DNA, 601 bp, Human
ccatcttaatagggaaattactgttgattgtaatgggcaactgatctagaaatttggtattgaagaaaatcaagtatgctcagaaatgtacttgataaaatttctgtacttgaacaattgcaaatgaagaggctgaggtcattacagaccagataggaacaggatgagaaaagaatatgataaggattagtaaagaacatataacatttacttagctatccagagagtccttaacatactatggtttgattttatgatggcataaaagcaatatccattcagtagaaaccatactttgcayactcatacaaccattctgcttttcacttttagtatggtattcaataaattacatgagatattcaacaatttattagaaactaggctttgtggtagatgattttgctgaactgtagactaacataattgttctgtgcacatttaagttaggttaggctaagctatgatgtttggtaggttaggtgtattaactgcatttttggcttgcaatattttcccgataggtttattgtgatgtaacctcatcagaagtcaaagacatctgtatatatatttcataattcttgtgcacttaggcata

SEQ ID NO: 205227 - DNA, 601 bp, Human
atttggtagtctaaataaccaccatttttattaggcttatagttttatgggtcagaattttgtgcaaagcccaacagagatgactcatttatgttccatgatgaccgggccctcagctggtatgagttgaatggctggagatatctggaaagatttgattgaaaccaaatgtctgaaaccttgattctgactgttggctgggttcccctgttcctttccacattatgtccttttggaatgcccaaggtagctgcttacctcacatgtctgatcctgagctgggaagattggaacagtagasggtggctgggtatcttttttcattcagcctctcaatgtgactagcttgggcttcctcatagcatggatgtctaaggtagatggatttttacatgagagctgttttcccccagagcaatagcagcccaggtggtagctgccaggtttcctataacttagaagccctatatcatcttatagttgtcacattgtatttgtcaggcaagtcactaaggccaacccaggttcaagggaagagacatttgaatccacctctcaatgagagaagcagcaaaaatttgaggctgtttttaaactacta

SEQ ID NO: 205228 - DNA, 601 bp, Human
tttcctccataaagtttacaaagacctgttagtctttcaaaatgacagcactgtgtatccagtgattcatactcagcttacctgaccaattaaactggagaacacaaaaactccagaaaaaaaattcaagagttgaaaaacaatttcaaataaagtttgtggttctggaaggccaccaatggtaattaaagttcgaactgcccaataataacatctcagatacctgtgaaaacagaagatatacattttgctttttttctatatcatcgaaagaccactattcttgggagaatatagtacwattaaattataacaaatttcctactaatcaagattttctttctctagacagcactggcaaacagcatgtgtgctaatgtaaacttcttaataaatgctgtgaaatgatgaaacaagcccaaggagggtgtttactagccgttaccaaaatttggtagtctaaataaccaccatttttattaggcttatagttttatgggtcagaattttgtgcaaagcccaacagagatgactcatttatgttccatgatgaccgggccctcagctggtatgagttgaatggctggagatatctggaaag

SEQ ID NO: 205229 - DNA, 601 bp, Human
aagttagttcaaaaaaagaagaaccagacagattttaatttttcctccataaagtttacaaagacctgttagtctttcaaaatgacagcactgtgtatccagtgattcatactcagcttacctgaccaattaaactggagaacacaaaaactccagaaaaaaaattcaagagttgaaaaacaatttcaaataaagtttgtggttctggaaggccaccaatggtaattaaagttcgaactgcccaataataacatctcagatacctgtgaaaacagaagatatacattttgctttttttctrtatcatcgaaagaccactattcttgggagaatatagtactattaaattataacaaatttcctactaatcaagattttctttctctagacagcactggcaaacagcatgtgtgctaatgtaaacttcttaataaatgctgtgaaatgatgaaacaagcccaaggagggtgtttactagccgttaccaaaatttggtagtctaaataaccaccatttttattaggcttatagttttatgggtcagaattttgtgcaaagcccaacagagatgactcatttatgttccatgatgaccgggccc

SEQ ID NO: 205230 - DNA, 601 bp, Human; identical to SEQ ID NO: 38913

SEQ ID NO: 205231 - DNA, 601 bp, Human; identical to SEQ ID NO: 38914

SEQ ID NO: 205232 - DNA, 601 bp, Human; identical to SEQ ID NO: 38915

SEQ ID NO: 205233 - DNA, 601 bp, Human; identical to SEQ ID NO: 38916

SEQ ID NO: 205234 - DNA, 601 bp, Human; identical to SEQ ID NO: 38917

SEQ ID NO: 205235 - DNA, 601 bp, Human; identical to SEQ ID NO: 38918

SEQ ID NO: 205236 - DNA, 601 bp, Human
agatgactgggcgcagtggctcatgcctgtaattccagcactttgggaggctgaggggggcagatcacttgaagtcaggagttcaagaccagcctggccaacatggcgaaaccccgtctctactaaaaatacaaaaattagctgggtgtggtggtgcatgcctgtaatcccagctacttgggaggctgaggcaggagaatcacttgaacccgggaggcagaggttgcagtgggctgggattgtgtcactgtactccagcctggacaacagagcaagactctgtctctaaataaataaatamataagtaaataaagtctacagatcctccaagcccctccattaactgccgactgcctcagcctcccttttttttcactcttctctgactactcttgcttccaccactctgcctttgctccagccactctggcttccttgcagtgtgtttccagctcagggcatcgtgtcatccatcctcccgtaatattccctcctgtcctcattcctctctctcctctcccatctgcgtagctcactcccttgcttcttgcagtcctctgcttaagtgctcaaatgcatttaatcagagaggcctttctt

SEQ ID NO: 205237 - DNA, 601 bp, Human
tcatcaaaatattgatggaaatctagcacaggccatagctaagaaaagagtcctagaatactgacctaactctaataacttagagtcatgggttaacctaatgctgggagtgactatgcctaaccattctactatacagcttctgcttcttcatcttgtttctaatattattgattatataattttaagacatatccttctgtctggattacattttttcttctttccatacttacatcttaagtgatcacattgagtcctttggcttgaaatacaccaatatgctgacaggtccaaatgkattgctccagcttggacgtctcccccgaactcagatttataaaccaaactgcctacatgaaattttcaactggaatctaacagtcacctcatcaaacaaacacatctgtttttgtgctgatattaaaaggacaccacagactgggtaatttataaataatagaaatttatttctcacagttctgaagaccgagaagtccaagatcaaggcattagcaggtttggtgtctggtgagggctgctctttcttccaagatggcgccttgttgctgcatcctccagatgggaggaacactgtgtc

SEQ ID NO: 205238 - DNA, 601 bp, Human
ttgctaagactacctctatgaaaataaatttagaaagattccatacctacatattttctatttcacttggctttacaaaaaaaaaagtttttttcatgtaacagaaatataaatgtaaatggattctttctggaaagaactgtatctttaacagaaatgtcaggaaagaatgaatctaagttatacacaacattagcaagatgtgaagatttaaccttttttctcaatcagatgttgctgatttggtggagtaccaaaaagtacatatagaaagcaaaaaaactatgaggcaaaaaactgrtatcttctcaaataggagatgatcccataaaagtcattggtatctaatttaaagcatttgttttcctttagaaaagagttacttactgtcacttattctcaattaagttcgtcattcaggtataacgagttttataatattttaaaacactgttaagataatttagcttagtgactttcatacatttctgaccatacctataataagacatacattttcattgtgcttagtacacacataaatatgtatatgtgattttaaaaataaaacatacaaaaattttataatacctactcttat

SEQ ID NO: 205239 - DNA, 601 bp, Human
caacaggccaccgactggcactgatctgtggccctggggtggggacccctgatctaatcaatttttctatgatcaggcagggccacaggaagaatctgattttacctgtgtagaaactcccacatggttgcatcagttttatttctccatttaataataactatgtaatttactatatgccaggtactgatataagtgcttcatatgttttgagtcccttacaaccaagtatgttatctcatttatttagtatctcccctcctatcggagggctccagagggcagaaacaacatggctgcmgtagctgggcagtagccctccatgtctggctcagtgctttagacaggtcaactgctgaggatgtatagttgaatggagttcatttagattataaactcactattcaaaatattttttaaaagtctagcaacaatacttcatttctaataccattagggtaaaaataaagttggtagaaatgaaacacaagtctcactgtagtctcactctcacgttctgatttcaggccctgtggagtaaatatgtgatgacatatcagataagtaggatgtcactgctggggatctgcatgtgagtgct

SEQ ID NO: 205240 - DNA, 601 bp, Human
actgacccaccactcaactccttctttgctgcccggttcccaacaggccaccgactggcactgatctgtggccctggggtggggacccctgatctaatcaatttttctatgatcaggcagggccacaggaagaatctgattttacctgtgtagaaactcccacatggttgcatcagttttatttctccatttaataataactatgtaatttactatatgccaggtactgatataagtgcttcatatgttttgagtcccttacaaccaagtatgttatctcatttatttagtatctcccctcctatcggagggctccagagggcagaaacaacatggctgcagtagctgggcagtagccctccatgtctggctcagtgctttagacaggtcaactgctgaggatgtatagttgaatggagttcatttagattataaactcactattcaaaatattttttaaaagtctagcaacaatacttcatttctaataccattagggtaaaaataaagttggtagaaatgaaacacaagtctcactgtagtctcactctcacgttctgatttcaggccctgtggagtaaatatgtgatgacatatcaga

SEQ ID NO: 205241 - DNA, 601 bp, Human
cattattgtgtgattaaaaagaattacatcctggggctttttctctcggcaacccagctccattttgtttacagttaggaaattttctgatgtatgaaaagacaggattgctttgtaaatgtctcttttttctataaagtgagagtaactgagaaagtatcaacattaacattatattagtacataatatttatactatgttttactgtcttatccttacctgtttaattcttccagcctcccactgatgcctggcattaatgaatatatggtcatcactcctggcttttagataagaacwggagtcccaggaagcctgtcgactttctctaaggtcacacatgcggtaggtattggaggaagagtatcaccagagtgtgtgtttttatctacacttggagcaacttgagatcaaagtgtttgtattattcactcttgtatccttagtgtctcatcagggtttagggcatgttggatggtaaataaaaatgggctgacatatagaatgaagctgttagaaattattccattttggacaatgagaaattcagtgctgtatagctgtgttaccgatttgaatgaggatattggagatttgaat

SEQ ID NO: 205242 - DNA, 601 bp, Human
tattattctttttttttctccagaaaatgattattttcttgagatatacattgcttcattattgtgtgattaaaaagaattacatcctggggctttttctctcggcaacccagctccattttgtttacagttaggaaattttctgatgtatgaaaagacaggattgctttgtaaatgtctcttttttctataaagtgagagtaactgagaaagtatcaacattaacattatattagtacataatatttatactatgttttactgtcttatccttacctgtttaattcttccagcctcccaytgatgcctggcattaatgaatatatggtcatcactcctggcttttagataagaactggagtcccaggaagcctgtcgactttctctaaggtcacacatgcggtaggtattggaggaagagtatcaccagagtgtgtgtttttatctacacttggagcaacttgagatcaaagtgtttgtattattcactcttgtatccttagtgtctcatcagggtttagggcatgttggatggtaaataaaaatgggctgacatatagaatgaagctgttagaaattattccattttggacaatgagaa

SEQ ID NO: 205243 - DNA, 601 bp, Human
ataaagtttgcattatgatgtcattatattttaaaatgtgtttgagaactattattattctttttttttctccagaaaatgattattttcttgagatatacattgcttcattattgtgtgattaaaaagaattacatcctggggctttttctctcggcaacccagctccattttgtttacagttaggaaattttctgatgtatgaaaagacaggattgctttgtaaatgtctcttttttctataaagtgagagtaactgagaaagtatcaacattaacattatattagtacataatatttrtactatgttttactgtcttatccttacctgtttaattcttccagcctcccactgatgcctggcattaatgaatatatggtcatcactcctggcttttagataagaactggagtcccaggaagcctgtcgactttctctaaggtcacacatgcggtaggtattggaggaagagtatcaccagagtgtgtgtttttatctacacttggagcaacttgagatcaaagtgtttgtattattcactcttgtatccttagtgtctcatcagggtttagggcatgttggatggtaaataaaaatggg

SEQ ID NO: 205244 - DNA, 601 bp, Human
tcagaaaaaaaatagcaataccacaataacaaaatacaaacgaaaaatacggtataactactatttacattgcatttggtactataagtaatctatagtgagttaaagtatacaggaggatgtgggtaggtgatatgcaaatactatgccacagattttggtttcctcaggggtcctggaaccaatcccctgtggataccatggggtagactatatttttttcaatactgaaaaaattggaaacaacgtactgtcaatctatgggcagataaaatattgaatatttgtagattggaatatyacaaagtagttaaaataaactacagatcggccgggtgtggtggctcacacctgtaatcccagattttggaggctgaggtgggtggattgcttgagctcaggagtttgagaccagcttggccaacatggcaaaaccccatctctactaaaaatacaaaaattagctgggcatggtgacacgtgactgtaatcccagctacttgggaggctgaagtgacaagatcgctagaacctgggaggcggaggttgcagtgagccaagattgcaccattactctctagcctgggtgacagagtgagac

SEQ ID NO: 205245 - DNA, 601 bp, Human
agtgttaccccttcccattggccctgtgaggcgtgctgcccttttctgtctgggatctgtaggtaatgaaaatgcttctattacttcatgggttttgttgtgctgctgcttctgtgtctcgcctgactgacatatccaaacctaacttttttttccagtagagggttttcctagggagtggctatcttataggaataaactggacacgggtcagacgaaagccacaacggcatcggccaatataaacaaattccctgtgaaagaaatgtctgttcatggtcgaccacctaggcatgaggtygccaaccgggatcaagaagtatcccatgaaaggcacactgtgaacagccaccactcatcctctggaaccccgtgagggcaaggctggagtacagccactctcccaagacagaacccaagaccaaatgagaggaaatcctaaaaatgtggcagcacagttggcctccgtatccatggattccacctccacgggttcaaacaactgtggatggagaatattcagaaaaaaaatagcaataccacaataacaaaatacaaacgaaaaatacggtataactactatttacattgcatttggtac

SEQ ID NO: 205246 - DNA, 601 bp, Human
gaatatatgtatatatacacacacacaaatatgtgtgtgtatagtaaattcttataattttatgttgccttggcaccaattttgaatataagtttaactttctcatactggaagtgggatcagtcacacttgacaaggtttccagttctctacctcttcccagttcctcagtgtggttgatccagatacctgctttataccactgcctcctggtgaccaccgctctatggtacagctggatgcaattgactagaattgccccactgacccccagagcccacgtagacgagcagatattccwcagtaactacctgtcagtcacagcaaggccccatggaactcatgtctgcttgctgtaaaccaacctgttagaacttcccctgggaaacctccctgggtaacaccctggatcccaaaaaggctttggcccattctctctctctccccactggttgagcacgagtgttaccccttcccattggccctgtgaggcgtgctgcccttttctgtctgggatctgtaggtaatgaaaatgcttctattacttcatgggttttgttgtgctgctgcttctgtgtctcgcctgactgacatatccaaa

SEQ ID NO: 205247 - DNA, 601 bp, Human
ctaaagcaaattacaaacataattttttttctaaaaggcatggttcttttttactaaaaattaaataaatgtcccaagtgcttaatttctttaaatgctgtcatcattttggaataatttcacttcagaaattggtattctgattcatttaaaactcacttagaaaaaggcaaatagactttggattgatttttggatcttctccactaaagaaaatttgtgtctttgatatggtaaagaaaatccacttgaaatatgcttggaagttcttgaacatgtacatgtctggaatatttctgcratgaaggtaactctcagtcactcatgtccatggagaagatttacattgtaaatgatcagaaatagaagatctcaaaagacccacttatattcgttttcatataaataattttaatttttggcactaatttttaaggttttaattataatttgtaaatcaaaaatgaaatttttattccttgaacaactcctatcagaatgtattttgatgaaaattcccaactatattaagttatattcatgggaaatattagtgattttaaatattgttttcctgtggcagtaattctgatttcatata

SEQ ID NO: 205248 - DNA, 601 bp, Human; identical to SEQ ID NO: 38919

SEQ ID NO: 205249 - DNA, 601 bp, Human; identical to SEQ ID NO: 38920

SEQ ID NO: 205250 - DNA, 601 bp, Human; identical to SEQ ID NO: 38921

SEQ ID NO: 205251 - DNA, 601 bp, Human; identical to SEQ ID NO: 38922

SEQ ID NO: 205252 - DNA, 601 bp, Human
tgaccatgcgtgcctgaaacttcattagcaattttaatttcaccccagtcctgtggtcctgtgatcttgccctgcctccatttggcttgtgatattctattaccttgtgaagcatgtgatctctgtgacccacaccctgttcatacactccctccccttttgaaaatgactaataaaaacttgctggttttgtggcttgtgggacatcacggaacctggtgacatgtgatgtctcccctggacacccagctttaaaatttctctctcttgtactctgttcctttatttctcagaccagccracacttagggaaaatagaaaagaacctacatgaaatatcgggggtggattttgcccgataaacgttcagcttttggttcccaaataacctctagtaattgccagatccaaaggatgcactggtccttgtgaaaactttgtccccaaagcatcctgtacacactctcttcctgggacacaattcatacatttaatcacctggtattgaagtctcttctaaggccctggaggacagtgattgtttcttgttctcctttgtaccctcatgactggcactgtgcctggcaaagaaggaatacat

SEQ ID NO: 205253 - DNA, 601 bp, Human
gtcagaccggttgtctgctctcaaaccctgtctcctgataagatgttatcaatgaccatgcgtgcctgaaacttcattagcaattttaatttcaccccagtcctgtggtcctgtgatcttgccctgcctccatttggcttgtgatattctattaccttgtgaagcatgtgatctctgtgacccacaccctgttcatacactccctccccttttgaaaatgactaataaaaacttgctggttttgtggcttgtgggacatcacggaacctggtgacatgtgatgtctcccctggacacccarctttaaaatttctctctcttgtactctgttcctttatttctcagaccagccgacacttagggaaaatagaaaagaacctacatgaaatatcgggggtggattttgcccgataaacgttcagcttttggttcccaaataacctctagtaattgccagatccaaaggatgcactggtccttgtgaaaactttgtccccaaagcatcctgtacacactctcttcctgggacacaattcatacatttaatcacctggtattgaagtctcttctaaggccctggaggacagtgattgtttcttgt

SEQ ID NO: 205254 - DNA, 601 bp, Human
acggagggaccggctgaagccatggcagaagaacgtggattgtgaagatttcatggacatttattagttccccaaattaatacttttataatttcttatgcctgtctctactgcagtctctgaaaataaattgtgaagatttcatggacacttatcacttccccaatcaatacccttgtgatttcctatgcttgtctttactttaatctcttaatctcatcatcttcgtaaactgaggaggatgtatgttgcctcgggaccctgggatgattgcgttaactgcacaaattgttgtagagcwtgtgtgtttgaacaatatgaaatctggacaccttgaaaaaagaacaggataacagcaatgttcagggaacaagagagataaccttaaactctgactgccagtgggccgggtggaacagagccatatttctcttctttcaaaagcaaatgggagaaatattgatgagttctttttctcagcaaggaacatccctgagaaagagaatgtgtccctgagggtaggcctttaaaatggccaccttgggggcggctgtcttttacggtcgcagctgtagggttgaaataagccccagtctcctat

SEQ ID NO: 205255 - DNA, 601 bp, Human
tttgaggaccagtgaaggtttgttgcaggaagtcagggacgccaaacggagggaccggctgaagccatggcagaagaacgtggattgtgaagatttcatggacatttattagttccccaaattaatacttttataatttcttatgcctgtctctactgcagtctctgaaaataaattgtgaagatttcatggacacttatcacttccccaatcaatacccttgtgatttcctatgcttgtctttactttaatctcttaatctcatcatcttcgtaaactgaggaggatgtatgttgcctcrggaccctgggatgattgcgttaactgcacaaattgttgtagagcatgtgtgtttgaacaatatgaaatctggacaccttgaaaaaagaacaggataacagcaatgttcagggaacaagagagataaccttaaactctgactgccagtgggccgggtggaacagagccatatttctcttctttcaaaagcaaatgggagaaatattgatgagttctttttctcagcaaggaacatccctgagaaagagaatgtgtccctgagggtaggcctttaaaatggccaccttgggggcggctgtct

SEQ ID NO: 205256 - DNA, 601 bp, Human
aaaagaaccctctttgtcattggacttggggcccttcaagataattcaggatgatctcatcttgagatccttaacttaattacatctgcaaagaccctgaccctttttttcaagttaggtcacatacacaagttcctaggattaggatgtggacttatctttgtgggagacaccattcaacccactacaggcatcacgtcaattatcctttacatacccctcagtaggggtttataggactgacctgtgtgcacacatcatttgaggaccagtgaaggtttgttgcaggaagtcagggackccaaacggagggaccggctgaagccatggcagaagaacgtggattgtgaagatttcatggacatttattagttccccaaattaatacttttataatttcttatgcctgtctctactgcagtctctgaaaataaattgtgaagatttcatggacacttatcacttccccaatcaatacccttgtgatttcctatgcttgtctttactttaatctcttaatctcatcatcttcgtaaactgaggaggatgtatgttgcctcgggaccctgggatgattgcgttaactgcacaaattgttgta

SEQ ID NO: 205257 - DNA, 601 bp, Human
ggtattgtattagtttcctagggctgctataacaaattatcacaaaacaactgacctacaaccacaaaaatttattatctcacagttctggaggccagaagtccaaaatcaaaatatcagcagggctgtgtttcctctaaagactccagtgaaaaatcttttcttgcctcttccagcttctagtgctgccaggcatttcttggctatggctgcaatacttcagtttctaccctcagtcttcacatggtcttctcctcttatgtcttttataaagacacttataaaaagtgtccttaggaaraagaaccctctttgtcattggacttggggcccttcaagataattcaggatgatctcatcttgagatccttaacttaattacatctgcaaagaccctgaccctttttttcaagttaggtcacatacacaagttcctaggattaggatgtggacttatctttgtgggagacaccattcaacccactacaggcatcacgtcaattatcctttacatacccctcagtaggggtttataggactgacctgtgtgcacacatcatttgaggaccagtgaaggtttgttgcaggaagtcagggacgc

SEQ ID NO: 205258 - DNA, 601 bp, Human
gaatgcctcctttcacagagtgaaaggtaactgtgcatgagagggagcacaacagccagggctcatggctcagaagtggagtgagaactgggttcctgccctcccggttcctctttggacattctggtgcagagaacatttggcacagccataggtggtagttctggtgcttgcaatttaggaaggaagaaaaacattgaagaaataaatgcactaatgcatgtatagttacaaagataagtgctccaaaagaaaggaacatcattggatgaaagtgtacagcagggagacctcggaggtycctatagtggggaatccaggaaggcctgaaagaagctgagatcttggtaaaagggtggggaaagcatccaggcggaggtaatagaatgtgcaaaaaactccctgtgactggatagagtgtggtgcattcaaggaatgggaagacaatgggtgtctggattaaagagagcaaggatggttaggcgcagtggcttgtacctgtaatccagcactctgggaggccgaggcaggtggatcacctgaggtcaggagttcaagactagcctggccaacatggtgaaaccccgtctctacaaaaata

SEQ ID NO: 205259 - DNA, 601 bp, Human
gggggtctgggggagggatagcattaggagaaatacctaatgtaaatgagttgatgggtgcagcaaaccaacatggcacatgtatacctatgtaacaaacctgcatgttgtgcacatgtaccccagaacgtaaagtataataaaaaacaatgtggcttttctaagcatgtgcagtcctgtgcttggctagaagaatgcctcctttcacagagtgaaaggtaactgtgcatgagagggagcacaacagccagggctcatggctcagaagtggagtgagaactgggttcctgccctcccggtycctctttggacattctggtgcagagaacatttggcacagccataggtggtagttctggtgcttgcaatttaggaaggaagaaaaacattgaagaaataaatgcactaatgcatgtatagttacaaagataagtgctccaaaagaaaggaacatcattggatgaaagtgtacagcagggagacctcggaggtccctatagtggggaatccaggaaggcctgaaagaagctgagatcttggtaaaagggtggggaaagcatccaggcggaggtaatagaatgtgcaaaaaactccctgtgac

SEQ ID NO: 205260 - DNA, 601 bp, Human
taacctattaaaatgcaatggcaatggggataataaagtaatatcagtaatactgaagaaaaatagctatacattgtgatttgtaatgcaaattggttcaatttttttctggaaaataatctgcccatatattacaagagttatagaaatgcttctaccttttggcctacttattccgatttttgggaattaaacctcaaataaataaaataaaacaaagtaattttacaaagataaatatagcagtgttattcttataatgaaaactgacaaaaagggcacaaggctgaatatgcatatwcacgacaaaaatgaatgtgcatttgtacattcacaaagatagaaagataattacattcacttatttattcaataactatttattaggcacttatgtggaccagccactgccctaagggctggggatagagtatagaacaaaccacacatggtgtctagcaggaccccttggtgcctgtgtaaagtgtcttcatgcaaactataaaaatggggcttttcatgcacacgtatatttatcgctgctctgttcacaatagcaaagacttggaatcaaaccaaatgtccatcaataatagactgg

SEQ ID NO: 205261 - DNA, 601 bp, Human
attcaaaaggatgtagtgaaaatgtaaatatgtactcttaacacaggtagtgcttacaggtttgagatatgaaaaaaatgaaaatgaagttttctctttcagtattaatcaagtcttatctctgctcatacttttaatctcctattgtatctactatttctactttttaggaaaggggaaaaaaggaataactgagttattctgatgaagagtaagaatatggaattaaaatagtccaaagacctagaagtctcctctggtattccaattttaaaaactgagtattcagaagaaatagacwataatgatttaaaggttaaaaggagttttaagatgatttgtcaaaatatttcgccatttcacattgatataaagtaaatatcagaaagaaattctcaaataggtgatttgactaatgtaataggggaaaagacagcatttaaatgttttgaatggcaaccagatatctaaaacatacaagaatatatcaatgcctgaattctactcaataacttgttatctgtgatgaaaaaaggatggtgaacaatgaaagaaatgcagaaggtaaatgatcacgtttatgaaaataaatgggcccata

SEQ ID NO: 205262 - DNA, 601 bp, Human
tgctaagcaaaaaggtgctatacaatcaaagagactatattcaaaaggatgtagtgaaaatgtaaatatgtactcttaacacaggtagtgcttacaggtttgagatatgaaaaaaatgaaaatgaagttttctctttcagtattaatcaagtcttatctctgctcatacttttaatctcctattgtatctactatttctactttttaggaaaggggaaaaaaggaataactgagttattctgatgaagagtaagaatatggaattaaaatagtccaaagacctagaagtctcctctggtaytccaattttaaaaactgagtattcagaagaaatagacaataatgatttaaaggttaaaaggagttttaagatgatttgtcaaaatatttcgccatttcacattgatataaagtaaatatcagaaagaaattctcaaataggtgatttgactaatgtaataggggaaaagacagcatttaaatgttttgaatggcaaccagatatctaaaacatacaagaatatatcaatgcctgaattctactcaataacttgttatctgtgatgaaaaaaggatggtgaacaatgaaagaaatgcagaa

SEQ ID NO: 205263 - DNA, 601 bp, Human
tgaggtatacttttcatgctaagcaaaaaggtgctatacaatcaaagagactatattcaaaaggatgtagtgaaaatgtaaatatgtactcttaacacaggtagtgcttacaggtttgagatatgaaaaaaatgaaaatgaagttttctctttcagtattaatcaagtcttatctctgctcatacttttaatctcctattgtatctactatttctactttttaggaaaggggaaaaaaggaataactgagttattctgatgaagagtaagaatatggaattaaaatagtccaaagacctaraagtctcctctggtattccaattttaaaaactgagtattcagaagaaatagacaataatgatttaaaggttaaaaggagttttaagatgatttgtcaaaatatttcgccatttcacattgatataaagtaaatatcagaaagaaattctcaaataggtgatttgactaatgtaataggggaaaagacagcatttaaatgttttgaatggcaaccagatatctaaaacatacaagaatatatcaatgcctgaattctactcaataacttgttatctgtgatgaaaaaaggatggtgaacaa

SEQ ID NO: 205264 - DNA, 601 bp, Human
ggcaaaaagccttgatttagcactggataaagttactttaggaggaatcctgaggatatttgaatgaatatttaagcaatgacactgattgtatatttgttcagtgggatattgtgggacttagatgaggtatacttttcatgctaagcaaaaaggtgctatacaatcaaagagactatattcaaaaggatgtagtgaaaatgtaaatatgtactcttaacacaggtagtgcttacaggtttgagatatgaaaaaaatgaaaatgaagttttctctttcagtattaatcaagtcttatctctgctcatacttttaatctcctattgtatctactatttctactttttaggaaaggggaaaaaaggaataactgagttattctgatgaagagtaagaatatggaattaaaatagtccaaagacctagaagtctcctctggtattccaattttaaaaactgagtattcagaagaaatagacaataatgatttaaaggttaaaaggagttttaagatgatttgtcaaaatatttcgccatttcacattgatataaagtaaatatcagaaagaaattctcaaataggtgatttgactaatgtaat

SEQ ID NO: 205265 - DNA, 601 bp, Human
gtggcaaaaagccttgatttagcactggataaagttactttaggaggaatcctgaggatatttgaatgaatatttaagcaatgacactgattgtatatttgttcagtgggatattgtgggacttagatgaggtatacttttcatgctaagcaaaaaggtgctatacaatcaaagagactatattcaaaaggatgtagtgaaaatgtaaatatgtactcttaacacaggtagtgcttacaggtttgagatatgaaaaaaatgaaaatgaagttttctctttcagtattaatcaagtcttatctctgctcatacttttaatctcctattgtatctactatttctactttttaggaaaggggaaaaaaggaataactgagttattctgatgaagagtaagaatatggaattaaaatagtccaaagacctagaagtctcctctggtattccaattttaaaaactgagtattcagaagaaatagacaataatgatttaaaggttaaaaggagttttaagatgatttgtcaaaatatttcgccatttcacattgatataaagtaaatatcagaaagaaattctcaaataggtgatttgactaatgta

SEQ ID NO: 205266 - DNA, 601 bp, Human
gcccagcctcccgcttgcccctggctttagacagcttttttgtttgtttgtttgtttgtttgtttgtttgtttgttttgagaaggagtctcgctctgtcaccaggctggagtgcggtggcacaatctcggctcactgcaacctccgactccctggtttaagcgattctcctgcctcagcctcccgagtagctgggattaccggcacgtgccaccacgcccagctaatttttgtatatatatacatatatttttaagtagagacagggtttcaccatgttggccaggatggtctcggtttcytgacctcatgatcccgccacctgagcctcccaaagtgctgggattacaggcgtgagccaccgcacccagctggtgaggtaggttcttaacctatacttacagacaaggaactgaggtccagaatcagttaagtgaattgttcaagaacaaatatttaagaatttcatctctgaaattaaaatctaagacaatacctgacttcaagtcaagaggtcttttctttaaccataactctagtgatgccaatgaagttactgctgttgttttaatgatacagatttgcccctggatattaggaaa

SEQ ID NO: 205267 - DNA, 601 bp, Human
ctggcaggtcagggaagttggtcaaattgaactcctggaccccgggcagcatagccaggtcctgcttgctgcaccactgctggtagtcaccgcctgtgtgccaggggcagaaggagtggaatcggatcctgtaggaagcctccagtgggagcgagaacttgttgaacatcatcacctggtacaagtactccttatggccctaggacatgaggaccctgccaagcccacagtaagctaatacatgcccagttttgtgctgtatccaggatcctggaggtcgggattgtcctgaaaagtggasttacaaaaccacggaggtctggggacagcatccaacggggaatgtgtctccaacgatcacccactggggctcccccaacagggccaagaccttccctaggtcatagaagcccaacaagctggaaccagtccttgcctgggtgagctttcggatgccctccgccatctggaaggcttggaaggagtgggagaagtctacacctgagtctgattcgtccaccagcccatgcagcaggtccacggcctccatgaccttcattttcttgtaggaaaagtccccaaaccaggcgtgcttgctcct

SEQ ID NO: 205268 - DNA, 601 bp, Human
agcctatactaatacactagcctaagtaaatgtttctttggagtgaaaaccaggtaactatgtgaaatatttgtacaaagtttatagttttaaagttttttttaaaagtaaatccctttattttcctatgtaatgaccatatcactttggtgagctaggtgttttgttttgttttgttttctctctccttcgaggtctttattgccactaggtacaaatggccatgagaggtggtggctataaggggcgagtggggttccccactgaggtggaccctaatggtgtctgtctgcccacagcmagacctcactaggcacgctgagggccaggcctgtcgtccagcagtggtgggggtggaagaagcgtcaccagctcaggatgccagggcagtacttatcaatgagcccctggtagtagggccgcagcttgtccacatctggcaggtcagggaagttggtcaaattgaactcctggaccccgggcagcatagccaggtcctgcttgctgcaccactgctggtagtcaccgcctgtgtgccaggggcagaaggagtggaatcggatcctgtaggaagcctccagtgggagcgagaacttgttga

SEQ ID NO: 205269 - DNA, 601 bp, Human
acatacagatttttaacaaaattagagagtttagatattacagatataaaatgcttagtcccttttccccttagcaggtcttgatttcagaactgaattggccttagagaagtgaatgagcgatgaagaatctgggtataacttctaaggaaggaaagaggagaaaaaggataatgtggactctttattccatgctctgtttatttatcttccttcgagtttcccagaagaatacttaactatggtactttggctggaaaatactgtatcaaagaagcctatactaatacactagcctaastaaatgtttctttggagtgaaaaccaggtaactatgtgaaatatttgtacaaagtttatagttttaaagttttttttaaaagtaaatccctttattttcctatgtaatgaccatatcactttggtgagctaggtgttttgttttgttttgttttctctctccttcgaggtctttattgccactaggtacaaatggccatgagaggtggtggctataaggggcgagtggggttccccactgaggtggaccctaatggtgtctgtctgcccacagccagacctcactaggcacgctgagggc

SEQ ID NO: 205270 - DNA, 601 bp, Human
aaacttgactaaaaataaattctagcaaaacttttatggctaggcaaatatcagaggatgttctaaggccacctctgcctgggatttttgatctttgcagatactttgatattcataaaagtactgaatggcaaacacatgttagcctagattttttttctgtaaaacattttgaggaatgtctgcacatacagatttttaacaaaattagagagtttagatattacagatataaaatgcttagtcccttttccccttagcaggtcttgatttcagaactgaattggccttagagaagtgratgagcgatgaagaatctgggtataacttctaaggaaggaaagaggagaaaaaggataatgtggactctttattccatgctctgtttatttatcttccttcgagtttcccagaagaatacttaactatggtactttggctggaaaatactgtatcaaagaagcctatactaatacactagcctaagtaaatgtttctttggagtgaaaaccaggtaactatgtgaaatatttgtacaaagtttatagttttaaagttttttttaaaagtaaatccctttattttcctatgtaatgaccat

SEQ ID NO: 205271 - DNA, 601 bp, Human
ttaagtctgcagaggttactgctgtctttttgtttgtctgtgccctgcccccagaggtggagcctacagaggcaggcaggcctccttgagctgtggtgggctccacccagttcgagcttctgggctgctttgtttacctaagcaagcctgggcaatggcgggcgcccctcccccagcctcgctgccaccttgcagtttgatctcagactgctgtgctagcaatcagcgagactccgtgggcgtaggaccctctgagccaggtgcaggatataatctcgtggtgtgctgttttttaagcccrtcggaaaagcgcagtattcgggtgggagtgacccgattttccaggtgccgtccgtcacccctttctttgattaggaaagggaactccctaaccccttgcgcttcccgagtgaggcaatgcctcgccctgctttggctcacgcacggtgcgcgcacccactgacctgtgcccactgtctggcactccctagtgagatgaacccggtacctcagatggaaatgcagaaatcacccgtcttctgcgtcgctcaggctgggagctgtagactggaactgttcctattcggccatcttggctcct

SEQ ID NO: 205272 - DNA, 601 bp, Human
ctgcctgttctcaaatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttctgggctgctttgtttacctaagcaagcctgggcaatggcgggcgcccctcccccagcctcgctgccaccttgcagtttgatctcagactgctgtgctagcaatcagcragactccgtgggcgtaggaccctctgagccaggtgcaggatataatctcgtggtgtgctgttttttaagcccgtcggaaaagcgcagtattcgggtgggagtgacccgattttccaggtgccgtccgtcacccctttctttgattaggaaagggaactccctaaccccttgcgcttcccgagtgaggcaatgcctcgccctgctttggctcacgcacggtgcgcgcacccactgacctgtgcccactgtctggcactccctagtgagatgaacccggtacctcagatggaaatgcagaaa

SEQ ID NO: 205273 - DNA, 601 bp, Human
tggagggtgcctcccagttaggctgctcaggggtcaggggtgagggacccacttgaggaggcagtctgcctgttctcaaatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttctgggctgctttgtttacctaagcaagcctgggcaatggcgggsgcccctcccccagcctcgctgccaccttgcagtttgatctcagactgctgtgctagcaatcagcgagactccgtgggcgtaggaccctctgagccaggtgcaggatataatctcgtggtgtgctgttttttaagcccgtcggaaaagcgcagtattcgggtgggagtgacccgattttccaggtgccgtccgtcacccctttctttgattaggaaagggaactccctaaccccttgcgcttcccgagtgaggcaatgcctcgccctgctttggctcacgcacggtgcgcgcacccactga

SEQ ID NO: 205274 - DNA, 601 bp, Human
ggtaaaaatagagtgagcagagcaatggaccaggaaacaaagaaatggttctaatcctagagccacctctatttgctatgaccttagacaataacataaagacttttttgatttccactctaatcatgtaagtatttattaagtgcctaccatgtattcagtacagtgaagtgggtaaaaaggagaattattaaagcatggtatggttttgtgaaaagaatacatactttggaaccagataatcctaccatctactgtgtttctgaacagattactaatgtctcctgtaggaaacaaggcyatatttagtacctactataggtatctgattatctttaagaagaaatagtactagtgtgccaaagttgagtactagtgtgccaaagttgggtgaatgaacaaaagcaggtgtgagaatgttatggagaaatggtgtattcagggactgtgtaagataacttgtatatgcaaaactcagtaaatgtgaggaacaagtatacacacacatacacacatacattttcacatacatacataaatagcatatgcaacagacatttatatacatatacatttgtgtgtatgtatatatatatatatt

SEQ ID NO: 205275 - DNA, 601 bp, Human
ctgtttcattcacattcctgttgtcatggacacagggtaatcctgtagttatgcaaggctggatgggattggggaggttaatttgaacctgagaatatctgtatatgtatgttagactatgagaatagaacggaaataacatatttaaatgtcaggttattttgagatttctcaagttttaattaaacttgcctacaggttacacgtttggagtgcttgatgagtttttaaatggaagaaatagtctgtctgccagatggattttgcccaaactctttcagcaatgtttaaaatagcatcttttttttttttcatcttgtccacaaaatgcttctccagcattccacccatggaaagtttcactcattaaatagcctaaatattcccagccccacatagagtttctgaaagagcccatgctggagtacaaagagttgaggttgctattgtttccctaggtaaaaatagagtgagcagagcaatggaccaggaaacaaagaaatggttctaatcctagagccacctctatttgctatgaccttagacaataacataaagacttttttgatttccactctaatcatgtaagtatttattaagt

SEQ ID NO: 205276 - DNA, 601 bp, Human
tctctttattaaagtttactcaattgcctcacttgagtgtgtctgtttcccacctgggctctggctgatacaactctcaacatcaaatgtgaaagccagcacttcatgatgccctggtcacctcaggtgaatccaatctcatctcctactatactccaaaatcaacttgttcctcagtgtcataagctgctctataatatagtcattcacatacatctccccacctggaatgccagggaattgtgggctttatgtcttggagggatataaaagagcattttgcatttgagaaataagcaamaaagagtgggggaataaacacagaaaggaataagataaatgaataaaaagtctgtcgttaccggtgatctgagaaggaaggattggtttgtaaaaacagaacaagaaaaaccacatttcaaatgtttaaaaaagacaccataggatctgcattgagaggataacacaacagattgaaccccttggagttaatctgttagaaactgagaaagaaggatcacattaacaaaagcagtttctacaggtggagaagacagagaaaacactctgacctttggaagcaatgagatataagaagctg

SEQ ID NO: 205277 - DNA, 601 bp, Human
cggaggggggtggcggggggaactgccctcatgatccagtcacctcccatcaggtccttccctcaaaacatggggattacaatttgagaaaagatttgggtggggacacaaagccaaaccatgtcagttgggtactcttagacttttcctcacttctgtcagtaatctctttattaaagtttactcaattgcctcacttgagtgtgtctgtttcccacctgggctctggctgatacaactctcaacatcaaatgtgaaagccagcacttcatgatgccctggtcacctcaggtgaatccartctcatctcctactatactccaaaatcaacttgttcctcagtgtcataagctgctctataatatagtcattcacatacatctccccacctggaatgccagggaattgtgggctttatgtcttggagggatataaaagagcattttgcatttgagaaataagcaaaaaagagtgggggaataaacacagaaaggaataagataaatgaataaaaagtctgtcgttaccggtgatctgagaaggaaggattggtttgtaaaaacagaacaagaaaaaccacatttcaaatgtttaaaaaaga

SEQ ID NO: 205278 - DNA, 601 bp, Human
aggctgtaagagagaaaaatgagtctttgccaccagtttcagttttcctccactgaaatctctttaaaaaaatagcaactattataagtatttatactgcttcagaaatcattccctagaggtgagggtccaggtgattgtgcagagagtgtcaagatgtgggaatagaaatggctcagttttcaatatattttttctctaactctcacctctaagtcccacaaatcaaggacttgtggctgtcagtatcctgtcagatccttcatcccagattccagaaatgcagaatccttttggactkggtatccctcatttgctccttcagatccacttttcacctctccccatgctcctttgtttcccaggaagctgacctctgtaggcttgccctctgacttcacttgggctcagccattggaaaagactaataggaaatcagaaagcaggaagagagtgggatcagagcatttatctcccctgttattttcctgccaagccttaggttagcagtggctgcagttctctaccaaaatctacagctcctgacacatggatgtcttctagaagtgcaattcccatcactcttgatgagttctggtaa

SEQ ID NO: 205279 - DNA, 601 bp, Human; identical to SEQ ID NO: 38923

SEQ ID NO: 205280 - DNA, 601 bp, Human; identical to SEQ ID NO: 38924

SEQ ID NO: 205281 - DNA, 601 bp, Human; identical to SEQ ID NO: 38925

SEQ ID NO: 205282 - DNA, 601 bp, Human; identical to SEQ ID NO: 38926

SEQ ID NO: 205283 - DNA, 601 bp, Human; identical to SEQ ID NO: 38927

SEQ ID NO: 205284 - DNA, 601 bp, Human; identical to SEQ ID NO: 38928

SEQ ID NO: 205285 - DNA, 601 bp, Human; identical to SEQ ID NO: 38929

SEQ ID NO: 205286 - DNA, 601 bp, Human; identical to SEQ ID NO: 38930

SEQ ID NO: 205287 - DNA, 601 bp, Human; identical to SEQ ID NO: 38931

SEQ ID NO: 205288 - DNA, 601 bp, Human
aactcgtcatttacattaggtatatctcctaacgctatccctccctgctcccaccaccccacgacaggctccggtgtgtgatgttcccacctcgtgtccaagtgttctcattgttcaattcccacctataagtgagaacatgcggtgtttggttttttgtccttgtgatagtttgctcagaatgatggtttccagcttcatccatgtccctacaaaggacatgaactcatccttttttatggatgcatagtattccatggtgtatatgtgccacattttcttaatccagtctatcattgayggacatttgggttggttccaagtctttgctattgtgaatagtgctgcagtaaacatacgtgtgcatgatgatcacttactcttattggtaagaaagttgatcatatatccttaatgtatgtatacttgtaagttaaatacatgtgctactatactaacatatattaaatacacatttaaaaaaaagattcagattaaaacagactgggaaataggagcccccctccctgcctttggaaactaccagggtagaccaccaatcccacataaaggaggattttcacacaggaattcttgtcct

SEQ ID NO: 205289 - DNA, 601 bp, Human
tgaggcaggaggattgtttgagcccaggaattttgagtccagtctgggcagcataatgagaccttgtctcttaggggaaaaaaaagaaacttaagattgtaagtttattttataacattaatcgtattaatgaaatttagatttatgattgcaactatgtactaattcttcaagaatgaagcacagttttttttttggagaggtatgcgctttttctgataaaattgcttaatggcctaatataacatgttccacttcacttttggctttttgcaaattagggtttgagaacacacaattytgtgattcatttggggcatattttagattgtaaggattcttttctctgttgcccaggcgagagtgcagtggtgcaatcgcagctcactgcaatctttgcctcccgagctccacccatcctcccatctcagcctcccgagtagcagggactacgggcacatgccaccacacgaagctaatttttgtattttttgtagagacaggattttggcatgttccccaggttggtctggaactcctgggctgaagcccatattagcctcccaaagtgctgggattatataggtgtgagccacggtgc

SEQ ID NO: 205290 - DNA, 601 bp, Human
gtattttcagactaatatatataactttgtaattttcatatagaacaatctatattaatatgcaaatttccatagcattttttaagtaggtagagtcattacaaggtgatggcaaatttatactttttccccaaggaaaaaatcttttgtactataggggtttatatgttaaattttaattttgtcctgttaagtatatctgatgtttttctcctaggctaatcatttagtattgagtgatgggtcagtgtcatgatttctgattttggtttaatagattttaatagtgaaagttaagatygctggcacgttttcttatattttattttcaattagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaagtaggtataacagaatttcttggtgtataagggaatttatgaatgttgaaaataaacatttacaaa

SEQ ID NO: 205291 - DNA, 601 bp, Human
ttttataatttaatagaaaatgattttgtaaaacgtggagttttcaagttgtcttattcttagctgtgaatccattggtctgttgatgaaaactgtcatttgctctacaaaatgagaaagctgtgcaacctcaagctttgcaacaccaaggaaataggtgtgctatgtgagcttactcttaaataatggcttttagtgagtgtagatagttcatgtgtaatgtacatcacattataccacctagggtttattgtaaactatattgctgctagatacatgtgaaaatattttctttcaattyaggtgtttcccatgatgaattgcttgacttagcaaagtttcatttcggtgactctttatgcacacacaaaggagaaataccagctctgcctccctgcaaattcacaggaagtgaggtagggcaagccttccagctagtatttagccttttggattccttgtgttgtatttacacataagtaaacaaaatgtgcatatttccagtaggaaaagaatggaataataggaaaagggaagaggatgtactcatttgcttacattccttcctcttccgtattctttaaccacctatttttcttcc

SEQ ID NO: 205292 - DNA, 601 bp, Human
attgtatgattggttcttgtttttcatgatagatatattctataaagttgctgtgaatggtcagttgggaagtactgaacatttgatcctaggagaaatatatatatacatctcacatagattataatcttttttttttttttttttttgagacagggtctcactttgttacctaggtggaagtgcagtggcacaatctcagcttgctgtggctgtcacttcctgggctcaagcgatcctcctgcctcagccccccaagtagctgggactacaagtgcataccaccatgctaatttttgcrttttttgtagagacatggtttcgccatgtggtccaggctgctcttgaacgcctggactcaagcaatccgcctgtctcggcctgggattacaagtgtgagccacagcatccggctgattataatcttaaatcctaaaaacaactcatcctggtagattcattttttctttatttcacaaaagagaaaacaaagttcagaagtgttaagtgacttggctgaggtcaccccactaacagattccagagctggcattcaaaccctgtccacctggccccaaagcctgaactgcttggattacac

SEQ ID NO: 205293 - DNA, 601 bp, Human
gtcagttgggaagtactgaacatttgatcctaggagaaatatatatatacatctcacatagattataatcttttttttttttttttttttgagacagggtctcactttgttacctaggtggaagtgcagtggcacaatctcagcttgctgtggctgtcacttcctgggctcaagcgatcctcctgcctcagccccccaagtagctgggactacaagtgcataccaccatgctaatttttgcattttttgtagagacatggtttcgccatgtggtccaggctgctcttgaacgcctggactyaagcaatccgcctgtctcggcctgggattacaagtgtgagccacagcatccggctgattataatcttaaatcctaaaaacaactcatcctggtagattcattttttctttatttcacaaaagagaaaacaaagttcagaagtgttaagtgacttggctgaggtcaccccactaacagattccagagctggcattcaaaccctgtccacctggccccaaagcctgaactgcttggattacacggcatttcccctacggtctccatcttctggtcatctctgtatgaaagctgaaacaagag

SEQ ID NO: 205294 - DNA, 601 bp, Human
tggagttcagtggcatgatcttggctcactgcaacctctgcctcctgggttcaagcaattctcatgtctcagcctcctgagtagctgcaattacagatgcctaccaccatgcctggctaatttttgtatttttagtagagacgtggtttcaccatgttggccaggctggtctcgaactcctgaggacaagttattttaactaatctctgagcctcagtttgctcatcttataaagggaataattgttgtcttgtgtacttcatgagtttttgagaggtccaaattaagtaataaatgtggyagactttgaaaacactaaactgccccataggcagtttaaaaaacgttaagtaaatctgtgatgaatacttttgaaagcaaagattcactttctaattagttttatataaagcaagctgttcttacaggatttgcttcaaagtgggatgtcacttgtgcctgaggacatgatttgagctgagatttttggtactttcaggtcatgcatagtgctactcttgagtggacttgaagagcttatctttccttttgtcttctcaggggctcgttttgatgatggtgctggaggtgacaatgaagt

SEQ ID NO: 205295 - DNA, 601 bp, Human
taccttactctgatacaatctacttctttctataccaaagaccttctccctcttatagatctcaacactccccagttctgtcttttcccgactctgccttctcctgaagttactatcttctctcattttctttactacccagctttgaaagagtactttacactttgatcctacttcatcacttcctaatcactcttcattcactgtaatctcttgccttcccgatcattttactcaaactgctttcaatgaggacaccgaaacttttagtttgccaaatccaatggttttttttttttttgagatggagtttcactcttgttgcccaggctggagtgcagtggcacgatctcagcttaccgcaatctccacctcccaggttcaagcgattctcctgtttcagcctcctgagtagctgggattataagcatgtgccaccatgcccggtccagtgttttttaaaataatttttcatgttatgtgattgacctctttctgaagcagtgacacaggtgactcttcccacgcccctttttttgagatagagttttgctcttgttgcccaggctggagtgcaattgtatgatctcggctcacagca

SEQ ID NO: 205296 - DNA, 601 bp, Human
aaaactgatcaccttcacctcttacctctttcactaaactttattaatcagttgaactgatcacgtgtataagaaattatgtccacaggattgcaaagcataggacatttaggagcattaagggatggtgttttataaggcatatgaagactggggtcccaacattaccctctcccatgccaaattataaccttgtcaatgaaaacaacaataaaacatcagacaacttttcttggacagaagacagggtgatatctacaaaggtgtgacctaagattacaaaataacgtaaaaaaaaaaaccaaaaaccaaaaaacaataaaaaggcagtatccactaagtgcagctgctatacttctaaagagaggtgaagtattattttttaaaagcttgccattggaggagtattttgtatccacacacacacacccatcctaatttcttatccctaatgggaaagtctatatgtaaaatggattgctttcttctgattctgaaggcaggggagaccgtggttttttgcttgttatgacaatataacacatgctgttaaatgtagttatggctgcagactatgatactgtatatcttttaaaaagca

SEQ ID NO: 205297 - DNA, 601 bp, Human
ttgctttcttttctgcttctttcttggctttttcttcttccttgaacttttttatccttggatcacagctgtatgcattgtctagcaaaagaaaaagttaatctcattttgaatttctaacatttaggggacttaaatcaattctacttaccaactaatgttcttattctgttcatttcttctttttttctttgtgctcttgttgctctgttctgcttttcaatccatctcctctcatcacgactataaaatagaaaatattggaaacaaactactgcttatagatgctatgactggaaaatgcaatattttataaaatatttatatgtacataacatcctagaggttaaaatgctgtgtcattactaacattaaacaatgatttttttttttttgagacagacttttgctcttgtcgcccaggctggagtgcaatggcgtgattttggctcattgcaacctctacctcccaggttcaagtgagtctcctgcctcagcctccggagtagctggaattacaggtgcctgtcaccatgcctggctactttttctatttttagtagagacagggtttcgccatgttggccaggctggtctcgca

SEQ ID NO: 205298 - DNA, 601 bp, Human
tttcatcatgttggccaggctagtctcaaactcctgacctcaggggatctgtctgccttggcctcccaaagtgctcggattataggcatgagccaccacgctcatagtgcagattcttaaataagattcttgtaactagttacatctatctgatgcaccttatccacaaacgtcagattagtagtacaatgttgaaccttctgttaatcaaagatttgcagtaatggaaactagtcaacaaggtattaaaaacctgatcattggttctgcttttcctaactgattttgtttcccactccayttccccataacattttttttttgtctgttttttttgagacaaagtctcgctctgttgcccaggttggagtgcaccgacatgatcatagctcactgcagctgtgacctcccaggctcaggtaatcctctaacctcagcctcctgagaagttgggactacaggtacacgacaccatgccagttaatttttgtattttcggtagagattttgtttatgttgcccaggctgaaccatactttatacttctacttctattttatagtttgtggtattcttctgaccttcattttaactctgtcct

SEQ ID NO: 205299 - DNA, 601 bp, Human
tttaagaaaggattggtggctcacaaaacatgaagtgaaagaactttttccacataaactgctttcaaaccttgtcatagcaagaaaaaaatttatatcacatcctaaacaaagacacacgtgatcaagagtttcacaagtatacccacccatataatgggtgtaacactcattttctattcaacacactaaattgacttcatgacccagtgatgggtcatgatttgtaacatgaaaagcattggtctagagtaatcacaacacccaagataatatcaaaccctaacatttttttttttttgagtcttactatgtttcctggttttgaaccctaacaatttttaacattttattttgaaataattttagaggagtagaaagaatccctgtatactctgcctacattccccaaatgtgaacattttcatatttgctaattatttttacctatatgtacagacatactttgaaccataagttacagacatgatgcctctttattccttaacacttctgtgtttttccttaaacataaggacattttcttatataattacagtacatttctcaaaatcaagcaattatcccgatataacactat

SEQ ID NO: 205300 - DNA, 601 bp, Human; identical to SEQ ID NO: 19500

SEQ ID NO: 205301 - DNA, 601 bp, Human; identical to SEQ ID NO: 19501

SEQ ID NO: 205302 - DNA, 601 bp, Human; identical to SEQ ID NO: 19502

SEQ ID NO: 205303 - DNA, 601 bp, Human; identical to SEQ ID NO: 19503

SEQ ID NO: 205304 - DNA, 601 bp, Human; identical to SEQ ID NO: 19504

SEQ ID NO: 205305 - DNA, 601 bp, Human; identical to SEQ ID NO: 19505

SEQ ID NO: 205306 - DNA, 601 bp, Human; identical to SEQ ID NO: 19506

SEQ ID NO: 205307 - DNA, 601 bp, Human; identical to SEQ ID NO: 19507

SEQ ID NO: 205308 - DNA, 601 bp, Human; identical to SEQ ID NO: 19508

SEQ ID NO: 205309 - DNA, 601 bp, Human; identical to SEQ ID NO: 19509

SEQ ID NO: 205310 - DNA, 601 bp, Human; identical to SEQ ID NO: 19510

SEQ ID NO: 205311 - DNA, 601 bp, Human; identical to SEQ ID NO: 19511

SEQ ID NO: 205312 - DNA, 601 bp, Human
ccccagtcgctgggaccacaggcatgtgccaccatgcctggctaattttttgtgtattttgtagagacggggtttcgccatgttgccaggctggtctcgaactcctgagctcaggcgatctactgacgttggcctcccaaagtgttgggatcacaggcatgaaccaccatgcctggccagggcctgttcctctttatgtggtctctctagcagggtagctcagggctttcaaaagtataaaagcagaagtcagcaggcctttttaaggcttcggcctagaattgccagtgtcgcttcatcsacattcagttagttaaagcaatcacaagcccagcccatttcaaggtgaaattactacagaggcatgaacaccatgaggtgtccatagggggccatcagcataacacactgccacatacatgcactcactttttttctttaacctaaagtgagatccatcagtagtacaggtagttgttggcaaagcctcttgttcgttccttgtactgagaccctagtctgccactgaggatttggtttttgcccttccagtgtatactctgaaagagcgatgcctccaggttgtccggagcctagtcaa

SEQ ID NO: 205313 - DNA, 601 bp, Human; identical to SEQ ID NO: 19512

SEQ ID NO: 205314 - DNA, 601 bp, Human
tgtgcccagttcaatattattgccactgtagtgatggacaccagttttagccaacatagcatagtactctatttcagatttcctttgggaaccaaaatgggcaaataaataaatgcgataccaagtgactgacagactaaatgttactacttcttttactagtgttaatgttgttaaggccttcaaaaagtaacaaaatcacatattactcttaaaaacatcatattcattatccaatacaaaccaacatttgtatgtatcccttgcaagtgaaggggcaaccagcaaatatctaatcaamccctactatgtttaagacagtatcaatactcacggaagagggtaagatgcaaataaaagaaagcaaagcattatctagcattagtaaggaccacatactttatatttccatgacaatctctaaagtaggtattatgtacttttttttttgagatggaatctcattctgtcgctcaggcggatcgtgcagtggcacgatctcagctcactgcaacttccacctcccgagttcaagtgattctcctgcctcagcctctcaagtagctgggattacaggcgtgcaccaccacacccagctaat

SEQ ID NO: 205315 - DNA, 601 bp, Human
gacaagatcgtgccgttgcacttcagccggggcaacgagagcaaaactccgtctcaaaaatataaataaataaacaacaacaataataataataataaaccatgttactgaaacctccctggcccatggcgagtttaacacacagttccttaggtaatttaaactacccaaagcaatgaatacgagaaagcaactctgggtaaggcaggataggctttgctgtttgaatgtggaaaacagcacatgcaaatatcaaggtgatgaatttggacaaccaaacgtccaatccactgaagttagaaaaaaaaaaaagtttaaacaagagccccacgcctgaacttagtgctgataactctaagtacttttagatccacggccggctttaaatttcaactccaagacgttaagtgatttgacctcctccaagctctaacttcccctaccctccgcggagagctggcccgggacaatgctttactcttttattccctactcccggcacctcagagaccagggtcgccaacgtcctcggcagacgcagccactcaggcttggaacagcctccggcgaggacccagcagacggcgtccggggcctgcgg

SEQ ID NO: 205316 - DNA, 601 bp, Human
attagccgggtgtggtggtgcatgcctgtaatcccagctacttgggaggatgaggcaggagaattacttgaacccgggaggcggaggttgcagtgagacaagatcgtgccgttgcacttcagccggggcaacgagagcaaaactccgtctcaaaaatataaataaataaacaacaacaataataataataataaaccatgttactgaaacctccctggcccatggcgagtttaacacacagttccttaggtaatttaaactacccaaagcaatgaatacgagaaagcaactctgggtaagkcaggataggctttgctgtttgaatgtggaaaacagcacatgcaaatatcaaggtgatgaatttggacaaccaaacgtccaatccactgaagttagaaaaaaaaaaaagtttaaacaagagccccacgcctgaacttagtgctgataactctaagtacttttagatccacggccggctttaaatttcaactccaagacgttaagtgatttgacctcctccaagctctaacttcccctaccctccgcggagagctggcccgggacaatgctttactcttttattccctactcccggcacctc

SEQ ID NO: 205317 - DNA, 601 bp, Human
acttgaatagcacacagccttcacaaactttaccaggtcctaaactgctctgaattcttcttccccagccctcctgaattactggtaagctccggatggccttggacgccttattcactgatgtctctcaacagtcaacagtgcctggcacgtggtaggcactcacattttggcagaacagctctctgcaaactctcaactctcagtgccagggtccactcagctggccactacccttaattctgccccctctcccaagtcagactcatctttttaaaaagatcaggccgcgcctggtgaytcacgactgtaatccctgcactttgggaggccgcggcaggtggatcacctgaggtcaggagttcgagatcagcctgaccaacatggtgaaaccccgtctctactaaaaatacaaaaattagccgggtgtggtggtgcatgcctgtaatcccagctacttgggaggatgaggcaggagaattacttgaacccgggaggcggaggttgcagtgagacaagatcgtgccgttgcacttcagccggggcaacgagagcaaaactccgtctcaaaaatataaataaataaacaacaacaataata

SEQ ID NO: 205318 - DNA, 601 bp, Human
gttttaagcacctgtgagacacttatgcaatgtccaggaagcggctgggaattccaagcttgctgctgagcagcactaagtgaaatacgctggctaatgtacaggcagggatgaggctcccaggaggacgcccttctcccttgctgaaactgattcagcaaatcctgttttcttctgtcattttacctaacactttggcagcggatggcactccctccctcctcctggccactgccacataacaatgagcttgccagctccccctcctacattcagcctatatacgctgcacatcccaggrcttgctttgcagccccttctctctccacactctcgcctcaagcaatctcacacattcctatatttttttgtttgttttattttggagacagggtctggctctgtcacctaggctggaacgcagtggcatgatctcggctcactgcaacctccacctcccaggttcaagccatactcccacctcagcctaccaagtagctgggactacaggcgtgtgccaccatgccgggctaatttttgtattttttgtagagatgtgttttgtcatgttgcctgggatggtctcgaactcctgagctca

SEQ ID NO: 205319 - DNA, 601 bp, Human
gcagaactgacagatttggtaaatgatagatggcgggaaaaagagggatgggcttggggaagaccatctggtgtctggcctgggccaccacatggaaaatgtttcatgactggagaagaacaaccaaagaaaagcaggcttcacagaaggaagaggagttaaatcctgggtacagcagtgttttaagcacctgtgagacacttatgcaatgtccaggaagcggctgggaattccaagcttgctgctgagcagcactaagtgaaatacgctggctaatgtacaggcagggatgaggctcccrggaggacgcccttctcccttgctgaaactgattcagcaaatcctgttttcttctgtcattttacctaacactttggcagcggatggcactccctccctcctcctggccactgccacataacaatgagcttgccagctccccctcctacattcagcctatatacgctgcacatcccaggacttgctttgcagccccttctctctccacactctcgcctcaagcaatctcacacattcctatatttttttgtttgttttattttggagacagggtctggctctgtcacctaggctggaacgc

SEQ ID NO: 205320 - DNA, 601 bp, Human
cactttgggaggccgtggtgggaggatcacttgaggccaggagtttgagaccagcctgggcaacatggagaaaccccatctctactaaaaatacaaaaattatccaggcgtggtggtgcacgcctgtaagtcccagctgttcaggtagctgagacaggagaactgcttgaacccaggaggtggaggttgcagggagccgagatcacgccactgaactccagcctgggcaacagagtgacactctgtctcaaataaataaataaataaataaataaataaataatagctgggcatggtggtrtgggcctgtagtcccagctacttgggaggctgaggtgggaagatcccttaagtccggaaggtcaaggctgcagtgagccgtggtcatgccattaaactccagcctgggcaacagggcaagactatctccaaggaaaaaaaaaaattctttagtcatccccttcactaacaggttcgagcccacactcttcgtaggaatccagacgagtattgctgagggttgagctagggcagtgaagatggagagggtggattcaagacatactagaggcagaactgacagatttggtaaatgatagat

SEQ ID NO: 205321 - DNA, 601 bp, Human
ctgagaaaaacaattattccatcatatctaatatccactccctattaaaatatccccagttctccccaaaatgtctttcattgctcttgtgggtaggggaatgggggcagacagggaggagggattaggaaccagtcaaggtttgtgtcatagagatctttctactaggaaaatgtccgcttagaattctttagacgtgtggctgggcacaatggctcacacctataatcctagaactttgggaggcggagggtgggaggactgcttgaggccaggagtttgagactagcctggggaacayagcaagacccccctctctacaaaaaaattaaaaattagcagccgggtgtggtgattcatccctgtaatgccagcactttgggaggccgtggtgggaggatcacttgaggccaggagtttgagaccagcctgggcaacatggagaaaccccatctctactaaaaatacaaaaattatccaggcgtggtggtgcacgcctgtaagtcccagctgttcaggtagctgagacaggagaactgcttgaacccaggaggtggaggttgcagggagccgagatcacgccactgaactccagcctggg

SEQ ID NO: 205322 - DNA, 601 bp, Human
gggcagatcacgaggtcaggagatcgagaccatcctggccaaatggtgaaaccccatctctattaaaaatacaaaaaaattagctggttgtggtggcgcacgcctgtagtcccagctaatcgggaggctgagacaggagaatcacttgaacccgggaggcagaggttgcagcgagccgagatcaccccactgcactccggcctgggtgacagagcgagactctgtctcaggaaaaaaaaaaaaaaaagaaagtagagtttggacataatgatacttctcccgtaaatccttcagcatgtayctccaaaacacaatgacagaactacaatgctatcatcacatctgagaaaaacaattattccatcatatctaatatccactccctattaaaatatccccagttctccccaaaatgtctttcattgctcttgtgggtaggggaatgggggcagacagggaggagggattaggaaccagtcaaggtttgtgtcatagagatctttctactaggaaaatgtccgcttagaattctttagacgtgtggctgggcacaatggctcacacctataatcctagaactttgggaggcggagggtgggag

SEQ ID NO: 205323 - DNA, 601 bp, Human
gagacctgttcccacacctttcatttccagaaacttcaaacccagaggagtttaaacatgacaagacttttctgccctgcatctagattttaaaaatgaacattttaccattaaaagtttttctctatatatatttgctttttaatttctttttttcttttttttttcagacagggccttgttctctcatgtcagctggagggcagtggcgcgatctcggctcacttcagcctccacctcctgcgctcgagcaattaccttgcttcagccacctgtatagctgggactacagccctgcacsaccacaccctgctaaatgttgtagttaccctgctaaatgttgtagttttagtagagacagggtttcatcatgttgtccacgctggtcttgagcttctggcctcatgtgatccgtgagccttggcctcctacagtgctaggattacaggtgtgaaccaccacacccggccctatatttgctttttaatttctactgaaccatttgaaagtagagttttgggctgggggcagtggctcacgcctataatcccaccactttgggagaccaaagcaggccaaggcgggcagatcacgaggtcag

SEQ ID NO: 205324 - DNA, 601 bp, Human
cagcatttggaagcacagacccgggggagagaagaggttgacagacccatgccaagaagactcctgccttaaagcagcagctccctgactcccctccccaccaccacactccatccagccccagtaccccgtcttccacactgctgctccagagacctgttcccacacctttcatttccagaaacttcaaacccagaggagtttaaacatgacaagacttttctgccctgcatctagattttaaaaatgaacattttaccattaaaagtttttctctatatatatttgctttttaatttctttttttcttttttttttcagacagggccttgttctctcatgtcagctggagggcagtggcgcgatctcggctcacttcagcctccacctcctgcgctcgagcaattaccttgcttcagccacctgtatagctgggactacagccctgcaccaccacaccctgctaaatgttgtagttaccctgctaaatgttgtagttttagtagagacagggtttcatcatgttgtccacgctggtcttgagcttctggcctcatgtgatccgtgagccttggcctcctacagtgctaggattacaggt

SEQ ID NO: 205325 - DNA, 601 bp, Human
agacaaacacgatcacaactcaaacagacaagctcttcaatgatgacacaaggaagtaggtagctgttgtggcatgggtaagggcagcctgggggcctgctctaacgaagtacctgttgagtggaagactggaaagaagaggagcagatggtcaggtagatacccatggaagggagattctaagcagaaccagtgaaggccaaagacacaagtgtgcaaacagcaccagcatttggaagcacagacccgggggagagaagaggttgacagacccatgccaagaagactcctgccttaaagmagcagctccctgactcccctccccaccaccacactccatccagccccagtaccccgtcttccacactgctgctccagagacctgttcccacacctttcatttccagaaacttcaaacccagaggagtttaaacatgacaagacttttctgccctgcatctagattttaaaaatgaacattttaccattaaaagtttttctctatatatatttgctttttaatttctttttttcttttttttttcagacagggccttgttctctcatgtcagctggagggcagtggcgcgatctcggctca

SEQ ID NO: 205326 - DNA, 601 bp, Human
tacacctgtcagccactgacgatgcacagatgaacctggccctgacttcacgggagctcagtttgctggtgagggcagacagacaaacacgatcacaactcaaacagacaagctcttcaatgatgacacaaggaagtaggtagctgttgtggcatgggtaagggcagcctgggggcctgctctaacgaagtacctgttgagtggaagactggaaagaagaggagcagatggtcaggtagatacccatggaagggagattctaagcagaaccagtgaaggccaaagacacaagtgtgcaaagagcaccagcatttggaagcacagacccgggggagagaagaggttgacagacccatgccaagaagactcctgccttaaagcagcagctccctgactcccctccccaccaccacactccatccagccccagtaccccgtcttccacactgctgctccagagacctgttcccacacctttcatttccagaaacttcaaacccagaggagtttaaacatgacaagacttttctgccctgcatctagattttaaaaatgaacattttaccattaaaagtttttctctatatatatttgcttttta

SEQ ID NO: 205327 - DNA, 601 bp, Human
gcccaggctggccttgaactcctggcctcaagcgatcctcctgccttggcctcctgaagtgttgagatttcgagcatgagccaccatgcccagctacttttgctctccaactgacctacacatagatcttttctgccttttcctagatcagtaatgtactgggattccaaagggccagcataaatgtccagaatcttagtgcttctggacataaaagtccagatgctgatgggccagtgtgaacctcttcttggggatctctttagaaacactagatgattttctacaacagtatttcttctttttttttttttttttaagacagagtcgcgctctgttgcccaggctggagtacagcggcatgatcttggctcactgcaagctccgcctcccaggttcacgccattctcctgcctcaccctcctgagtagctgagactacaggcgcccgccgccacacccggctaattttttgtatttttagtagagatggggtttcaccgtgttagccaggatggtctcgatctcctgacctcatgatccgcctgcctcggcctcccaaagtgctgggattacaggcgtgagccactgcgcccagcctt

SEQ ID NO: 205328 - DNA, 601 bp, Human
gccatgttagccaggctggtcttcaacccctgacctcaagtgatctgcccacctcggcctcccaaagtgctgggattataggtgtgagccactgcgctcagccctcttctgaactttatgtaaccatgatcaaatgacaaacagcgtttccctcatcttcttggtttttcacatctatgtacaataaaatgtacttttttggcagacagtactgagttttgacaaatgcctaaagtaatgtaaccagcatcacaacagcttcttcaccccttgaagttaatccttttataatcaacccctytccccatctctagcaaccactgctgtgttccttgtccctcagttttgccttttctagaacatcgtatgtatggaatcatacagaagggtagccttctgaattcctgccccttctttctgcacaatcccttttataattggtgatcttacctctggccaggtctatcacagcataccctttatacttttgttctctttttatttttgagacagggtcttactctgttgcccaggctggagtgcactggtgtgatcacggctcactgcagccttgacccccagagctcaaacgattccccca

SEQ ID NO: 205329 - DNA, 601 bp, Human
aactgcccccacaaacctcagaataccaactttattaacacataatttgctaattttcatctcataattaaatttctattgtgaatgctttcagaaagtgaggataaatttgactcaagtcacaaactatactttactcatggattttttctttctttttttgagactgggtcttgccctgtcacccaggctggtgtgtggtggtgcgatagctcactgtagttcactgtagcctcaaattcctgggctcaagtgatcgtcccacctcagcctcctgagaagctgggactagaggcatacrtcatcttgcatggttaatttttttaaattttttgtagagatggggtcttgctatgttgcccaagttgttctcaaactcctggcctcaagcaatgctcccacttcagcctctcaaagtgctgggattataggtgtaagccactgcaattggccctacttcacaaatatctatgtgcatgttgaactcccatatgccagctaataggaatacaaatttgttgacctcccaagagggcagtgtggcatcatccatatcaaaatggaaactgtgtatgacttcagcccaataatgacacttgcg

SEQ ID NO: 205330 - DNA, 601 bp, Human
gtgttgcccaggctggtcatgaactcctgagctcaggcaatccacctgcctcagcctcccaaagtgctaggattacaggcaggagctaccgagcctggccaaaaaaaaatcaagatttgtaaaaattaactttaaaaatcaaaaattttttaactgcccccacaaacctcagaataccaactttattaacacataatttgctaattttcatctcataattaaatttctattgtgaatgctttcagaaagtgaggataaatttgactcaagtcacaaactatactttactcatggattttttctttctttttttgagactgggtcttgccctgtcacccaggctggtgtgtggtggtgcgatagctcactgtagttcactgtagcctcaaattcctgggctcaagtgatcgtcccacctcagcctcctgagaagctgggactagaggcatacgtcatcttgcatggttaatttttttaaattttttgtagagatggggtcttgctatgttgcccaagttgttctcaaactcctggcctcaagcaatgctcccacttcagcctctcaaagtgctgggattataggtgtaagccactgcaattg

SEQ ID NO: 205331 - DNA, 601 bp, Human
ataaacatctgctttgttttaagggcattttttaataaagagaaatgtgctggaatgagcaagaaattcaatgctattgttacatttcataagctatcttcaaaaacaaaacaataaaaaacaaaaggtttttcttctaaaaagtatgctgattatagggacaaaattgtttgctttcttaagaacgtagtagatattaaaggtaaaaacaaaactaaactaaaaacctttttcttcacatttgctcaccatgggtcattaaaatactatttctgttaacttaaaagctggtaagcttagytctcccctttcgtcttaaagtttacaaattctgtaagcaggtttagatcgcaaatcataggagaatcagcggaagggacttggatcctggagaacagaggagttgggaagaaatggcagctatgttcaaatacatacaggactctcacagggcagttttacttaggggaatcaatgaaggactcagagatgtgaattcttattcctaacactcagagctgtccagagatggaacttacttcaggacaggcagtcaggaaggtctgtggaaaggactccagcactggataagtagatggac

SEQ ID NO: 205332 - DNA, 601 bp, Human
gaagtgataagacaggacaaaaaaggtaatccaggacaacatcggcatagggaaaaattccatttttatgagaaaagacttagaaataaacatctgctttgttttaagggcattttttaataaagagaaatgtgctggaatgagcaagaaattcaatgctattgttacatttcataagctatcttcaaaaacaaaacaataaaaaacaaaaggtttttcttctaaaaagtatgctgattatagggacaaaattgtttgctttcttaagaacgtagtagatattaaaggtaaaaacaaaacwaaactaaaaacctttttcttcacatttgctcaccatgggtcattaaaatactatttctgttaacttaaaagctggtaagcttagttctcccctttcgtcttaaagtttacaaattctgtaagcaggtttagatcgcaaatcataggagaatcagcggaagggacttggatcctggagaacagaggagttgggaagaaatggcagctatgttcaaatacatacaggactctcacagggcagttttacttaggggaatcaatgaaggactcagagatgtgaattcttattcctaacactcag

SEQ ID NO: 205333 - DNA, 601 bp, Human
ccaccagatgctggggctacaggaccaagggtatgtaagtaccatgtgctaaccgactgcaccactggagctccatacgaccagggatacataaatggttaacagagaaaagttccaaaacggtctaagtctaactaactgaaaacccatacatctttatgacccagtatagtgaccacatcatgtgtacttttggaagagtagcatttactttttaaattaggatctgatattaaatgtatctgatgcgtgactcatgaatgttcagaaataacatgggatcaatgaaaatcgaggacarggaaagagggattctgctagggaaatgtatgtccaacatttccttttcgtcgcatgacatgagcaggaatagacaaccctgcattggaggcagtgcccaggaggaagcccagtacacatgattcaggtggggtccagaaaggggcctggcaacggggcccaggtttttcaccaacacaaagtcacgcatggatttgtagccactcctctttgctggggaccccaaacctgctcttaggagccctggccttacctgaatggagattgtaaggcaggcagtacttgtacccagaactggatg

SEQ ID NO: 205334 - DNA, 601 bp, Human
ccttctgggttcaagcaattctcgtgcctcagcctcccgagtggctgggattacagttgtgcaccaccatgctcggctaatttttgtatttttagtagagatgaggttttgccatgttggccacgctggtctcaaactcctggcctcaactgatatgcctgccttggcctcccaaagtgctgggattacaagcatgagttaccgcacccagcccagtcaccggtttcaaagtaccaccttatcagtttcaaagcataattgacttttataataagaacaataagaatttttttttttttttgagacagagtcttgctctgtcgcccaggctggagtacagtggcgcaatctcagctcactgcaagctccacctcccgggttcacgccattctcctgcttcagcctcccgagtagctgggactacaggtgcctgccaccaagcccggctaatttttttgtattttttttagtagagacagtgtttcactgtgtaagccaggatggtctcaatctcctgaccttgtgatccgcctgccttggcctcccaaagtgctgggattacaggcgtgagccaccgcgcccggtcagaattgttgtttga

SEQ ID NO: 205335 - DNA, 601 bp, Human
ttgtttttttgaggcagagtctcactctgctgcccaggctgtagtgcagcggtgtagtctcggcacactgcaacctctgccttctgggttcaagcaattctcgtgcctcagcctcccgagtggctgggattacagttgtgcaccaccatgctcggctaatttttgtatttttagtagagatgaggttttgccatgttggccacgctggtctcaaactcctggcctcaactgatatgcctgccttggcctcccaaagtgctgggattacaagcatgagttaccgcacccagcccagtcaccrgtttcaaagtaccaccttatcagtttcaaagcataattgacttttataataagaacaataagaatttttttttttttttgagacagagtcttgctctgtcgcccaggctggagtacagtggcgcaatctcagctcactgcaagctccacctcccgggttcacgccattctcctgcttcagcctcccgagtagctgggactacaggtgcctgccaccaagcccggctaatttttttgtattttttttagtagagacagtgtttcactgtgtaagccaggatggtctcaatctcctgacctt

SEQ ID NO: 205336 - DNA, 601 bp, Human
caggcattagccactttaataatgctgctatgtggggctttctttctagtcctcagtaggaaaatttctagaaagtgttatattattgccttttactcttatcatgttatataatttgttcaacagtcacagtgtttattagctgctctcctttaaccacaacagatgttacatattgtaccttatcctgcactttaggtctttcttcttaaaaacaaatatgttatttagaaaaatatcaaataataagcattatgtgtaaggccataaaaagcaaaagagcttagccttggtgacagtgagacccagtcttaaaaaaatacatatatatacatatatatacatataatgctagacatacatcacagaatgtacacacaagttctgttgtcagccttacaaaatgcttgtgctttttcacagaggagtaaaaggaataacttatatttctgtacttactcggagttggtaagacctgagttcatatatattaggtccggatcttggcacaggctcattccagaaactgaactccaacaggagctgattcttcctggagagaagcatgtcacttcttgccttacgaaattccaaaaattcc

SEQ ID NO: 205337 - DNA, 601 bp, Human
ttttttttgagacagaatcttgctccgtcacccaggctggagtgcagtggctcaatctcagctcctgaaacctccgcctcctgggttcaagcaattctcctgcctcagcctcctgagtagctgggattaccggcgcccgccaccatgcctggctaattttttatatttttagtaagagatggggtttcaccatgttggccaagctggtctcaaactcctgacctcaggtcacccacctgccttgacttcccaaaaagctgggattacaggcatgagccaccacacccagccaaaactttastttttaatttaatagagacagggtctcactatgttgttcaggctggtctcaagcttcctggctcaagcaatcctccaaccttggcctcccaaagtgctgggattacaggcattagccactttaataatgctgctatgtggggctttctttctagtcctcagtaggaaaatttctagaaagtgttatattattgccttttactcttatcatgttatataatttgttcaacagtcacagtgtttattagctgctctcctttaaccacaacagatgttacatattgtaccttatcctgcactt

SEQ ID NO: 205338 - DNA, 601 bp, Human
ctggcaagttttttttttttttttttttttttttttttatagagacagggtttcaccatgttgcccaggctggtcaccaactcctagcatcaagcgatcctcctgccttggcctcccaaagtgctaggattacgggtgtgagccaccacacccagctgctgtcttttcaaattctttacccattttttaattgagttatctgtattcttattattgagttgtaagaattatttatctattctgaattcaatttgcttatcagacatatgatttgcaaatattttattccagtatatgacttgtctttttaattaaatttttttttttagtatcactgaaagtaaggcaattttttgttttgttttgaaacagtctgctgtcacccaggctatagtgcaatggggtgatcttggctcactacaacctctgtctcccaggttcaagtgattctcctgcctcagcctcctgagtagctggaactacaggtgcacaccgccatacgtggctaatttttgtatttttagtagagacagggtttcaccaagttggtcaggctggtctcaatctcctgacctcaagtgatcttcccaccttggcctcc

SEQ ID NO: 205339 - DNA, 601 bp, Human
tttaccatcttacccatttttatgcagtgtccagtatatttacactgttatgccacagatctccaaaacattttcattttgtaaaactgaaactctatactcaataaacaccaattccgtattccctctctgcccagctcccggcaaccacctttccactttctgtttctatgattttggcaacactggatacttcacataaggagaatgatacactatttgtcctcttatttcacttagcattacatcctcctcaatgttcaccatattgcagtataagacaagacttccttcttttttrgaggcgggggatgaagtctcgctctgttgccaggctggagtgcagtggcgcgatctcagctcactgcaacctccacctcccgggttcaagtgattctcctgcctcagcctgctgagtagctggggctacaggtgcacgctaccacgcccagctaatttttgtatttttagtagagacggggttttgccatgttggccaggctggtctcaaactcctgagctcgggtgaccagcctgccttggcctcccaaagtgctgggattacaggtgtgagccaccgcacccagcccacaatttcttt

SEQ ID NO: 205340 - DNA, 601 bp, Human
ttatacacatatatataagtgtttatatggatggtatcttttgggtagacacccaggaatgaaattgctgggtcatatgtaatttttcttttcttttttttgagatggagtcttgctctgtcacccaggctggagtgcagaggcgtgaccttggctcactgcaacctccacctcctgggttcaagcgattctcctgcctcagcctcctgagtagctgggattacaggtgcacaccaacatgcccggctacgtttttggtatttatttttagcacagatggggtcttgtcacgttggccagrtcggtctcgaattcttgacctcaggtgatccgcgccctcagcctcgttaagtgctgggattacaggcgtgaaccactgcgtccagcccacatgtaatttctgagggactactagactatttccaaagtggctgcaccattttacattcccatcagcaatatcggaagggtccactttctcctcacctcactaacacgttattatctatctcttttaagttacagctgtcccagtgtgcaggaactggtatcccattatagtttcactttgcatttccataatgactaagaaggttgagtc

SEQ ID NO: 205341 - DNA, 601 bp, Human
aaagttattttatttactttattattatttgagacggagtctcattctgtcacccaggctggagtgcagtgacacaatctcagctcactgcaacctccacctcctgggttcgagccatcctcctgcctcaacctcctgagtagctgggattacaggcacccgccaccatgctcggctaatttttgtatttttagtagagacaagatttccctatgttggccaggcttgtctcaaactcctgacctcaagtaatccgcccgcctcagcctcccaaagtgctgggattataggcgtgagccaycacacctggtctaaaagtcattttaatgtatatgaaatgtaagcatacttttctgtagctatactaatttttttgagaaaatgtatttaataattattaaaaataaaaacagcaacctgaagatgtatatatagttgcactggtgattcttgaaataaagtctagaactggcagaggatgggacccgtcaatttaaaaagcactgcttctccagaacaccctcagaggggaagcgaggcaaacctggaactagagcacccaaggtgccacagggcactgtacccaagggagacagggacc

SEQ ID NO: 205342 - DNA, 601 bp, Human
ctccgcctcttgagttcaatcgattcttctgcctcagcatcttgtgtacctgggattacaggcatgcgcctccatgcctaattttctgtatttttagtacagatgaggtttcaccatgttggtcaggctggtctcttaactcctgacctcagatgatccacctgcctcggcctcccaaagtgctgggattataggcgtgaaccactgtgcccagccaatatcttgttaattacatttttttttgagacagggtcttgctctatttgcccagactggagtgcagtggcacagtcatagctcrctgcagcctcaaactcctggcctcaagcaatcatcttcaacttgctgttgctctgtgaagccttgagtcctcccgacagggcagagacaagaggtctgtcctgcattccccacagcctctatgagagctccgccattcacactctggtgcctgcctgtttgccattccaggatcctgcatctgggaggccctctccgggcagctacaggtgctgatgtgaatggagcatgcacctggcttgacctctgcccaacagccaaagggatggaaccttcctccatccaatcctgcccttctagc

SEQ ID NO: 205343 - DNA, 601 bp, Human
taagagattacctgtgtaatataccaattcctcccagccatgtttgtgccatgctgcattccgtatgtcttccctggtctgaagatccctgtaagcttaaaaataaccacacagagaagtaagacttaaaacacatacactgcattccacccatacatccgttaaagtcttgcttcacctggacatctagttttctcagggactacttcaggtgtgtaatatactgggctggggaaattctgagcaaaattatattaggccacgtgggaaaagcaaactttcagtctttttttttttttttctgagacaaggtcactctgtcaaccagcctggagcgcaatggcacgatgatgtttcaccacggccttgacctcctaggctcaagtgatcctcccacctcagcctgctgaatagctgggactacaggaatgtgctaccacattggctaatttttgtatttttttgtgcccagtcagatgtcaaactcctgggctcaaatcatcaaaacgcctcagtctcccaaagtgctagaattacaggggtgagccaccacgcctggcccattcttaagttaaaaaaattatttgtttgtttgtttgag

SEQ ID NO: 205344 - DNA, 601 bp, Human
gctgggcgcagatcacctgtaatcccagcactttgggaggctgaggcaggtggatcacgaggtcaggaaatcgagaccatcctggccaacagggtgaaaccctgtctctagtaaaaatacaaaacttagctgggtgtggtggcgcctgcctgtaatcccagctactcaggaggctgaggcgggagaatcgcttgaaaccgggaggcggaggttgcagtgagccgagatcgcgtcactgcactccagcctggcgacagaacaagactccgtctcaaaaaaaaaaaaaaaaaaaaaaaaaaamcagatcctacctggatatttgttttatttgtgggaggtaggaaaagtccatactgtgaggagaaatggtgatttctcaaacgttcgcgtaagcagcaaaatcaaatacaattatataattataacatgtaattatatgttatataatctcttgaactgaaagacaaggtaacacctactttctaggacaaattactcttttattttcttggtagtataggggctgagatacacttttttttttttgagacggattcttgctctgtcacccaggctggagtgcagtggcacaatctccacc

SEQ ID NO: 205345 - DNA, 601 bp, Human
tgtttgactgcaatttttccaagacattcaaggtaacattgtcttttaaaatctgtgaaattttgctgcggcgcaaataacctcttgcccattgtatactggtctttgctcaatgaaagctttctaatggtaccttcatttcaagcctcatttaaagacaatatcagcactctaaattgtaccaaattcctgtcctctgaaattagatgttaagattatgtgtttgtatagtctaaactgatgattgtggtattacatagtcagctgctcattaatatagatgaagctaaaatgagtcacrgacaaggatagttaataaacaggttggctaactagaacacctacctgattttaaaatagaaaatccttcctttataccaagaaatgtgagaacattctgcatttgaaaaagttttcttttctctccaatcttctgaagggccattattacatagcatttcctctatccctctacacttttcttttcttttttttttttttaaatagagacaaggtctcaccgtgttgcccaggctaatcccaaactcctgggctcaagtgatcctcctgcctcagcctctcaaagtgctgggattacagg

SEQ ID NO: 205346 - DNA, 601 bp, Human
atctctctagatctaataacatttaatttttttctaatttttattttattttattttatttatttatttttttggagatggagtctcgctctgtcacctgggctggagtgcagtggcgtgatctcggctcattgcaacctccgcctcccaggttcaagggattctcctgcggctgcctcccgagtaggtgggactacaggcgcccaccaccacgcccagctaatttttgtattttagtagagacgggttttcaccatgttggccaggttggtctcccaacttctgacctcaagtgatccamccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagttattacctagtgctagtagtttggaggaagagaaacaggtttcattaattagtgataaactgtcaatgtatgtgcttatccttatataaaattacttgctat

SEQ ID NO: 205347 - DNA, 601 bp, Human
aagggattctcctgcggctgcctcccgagtaggtgggactacaggcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcaccygtcttttcctagcaaggaagcttttcagtgaggggccttcagttattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatcta

SEQ ID NO: 205348 - DNA, 601 bp, Human
gcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagtyattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatctagaaataaaagattaactctttgcatatttggaatagctgcttca

SEQ ID NO: 205349 - DNA, 601 bp, Human
tttttgagacagagtcttgctttgttgcccagggtagaacccagtggcgtgatctcgtcttactgcaacctttgcctcctgggttctaacaatcctcctgcctcagcctcctaagtagctgggattataggcgcacgccacaacacccggctaatttttgtttgttttttgagacaaggtcttgctcagtcgcccaggctggagtgcagtggcacgatcctggctcactgcagcctctgcctcctgggttgaagtgattctcctgcctcagcctcccaagtagctgggattacaggcatgygccaccatgtccggctaattttttatttttagtagagacagggttttgccatgttggccaggctggtcccaaactcgtgacctcaagtgattcacccgctgtggcctcccgaagtgctgggattttaggcgtgagccactgcgcctggcttattatgaaacttttaaagtgattatcttttcagtgaatctggtattttggggtttagtcatttatagggtactgacacaactttttttttctccaaaatttattctaataccattattgggcagattgtcctttcaccactgatttgaa

SEQ ID NO: 205350 - DNA, 601 bp, Human
tcactttatcatccaggctggagtgcagtgacgcaatcacggctcactgcagcctccgcctcctgggttcaagcggttatcctgcctcagcctcccaggtagctgggattataggcacccaccaccatgcctggctaatttttgtatttttagtagagacggagtttcactgtgtttgccgggctgatttcgaactcctgacctctagtgatccgcccacctcagcctcccaaagtactgggattacaggtgtgagccaccacacccagcctatacttacactttttttttttttttttttgagatggagtttcgctcttgttgcccaggctggagtgcaatggtgtgattggttcactgcaatctccgcctcccgggttcaagcgattcttctgccccagcctcctgagtagctgggattacaggcatgtgccaccacacccagcaaattttttatttttagtagagtcagggtttctccatattggtcaggctggtctcgaactcccaacctcaggtgatccatctgcctcaggctcccaaagtgctggggttacaggtgtgagccaccacgcccagccttatacttatactttttaag

SEQ ID NO: 205351 - DNA, 601 bp, Human
ctcccaaagtgctggcattgcaggcgtgagccactgtgcccagcctaacttgacttttttaagcataaggtaagcatctcatcaaatagtgtgatgttttactttaattttgttttttctttgaattaaattttttttttttattttttaaagacagggtcttgctaagttgtccaggctggtctccaactcctggcctcaagtgatcttcccatcatgacctcccaaagtactgggattgcaagcaggagccactgcattcagcttcactttattttttaatttaaatttttttttttttgagacagagtctggctctgtcgcccaggctggagtgtagtggcatgatatcagctcactgtaacctccgcctccaaggttcaagcaattcttgtgcctcagcctcccaagtagctgggatacaggggtgcaccaccacacccagataatttttgtatttgtagtagagacggggttttgccgtgttgcccaggctggtcttgaactcctggcctcaagtgatctgcccacctaggcctcccaaagtgctgggattacaggtatgggccaccacacctggcccccagcttcactttaattt

SEQ ID NO: 205352 - DNA, 601 bp, Human
agtatgtatccttctatatattttctatgcatttgcaaacgtgtatgtatgtttctataaattctttattaacagttttattaacatgacaaatgacatacagctgatattttgcagacctggtgggcatggggagcttggagcccagtgccacccaccctggccctccatggccttaaaaaaaaattatatggggccgggcatggtttctcatgcctataatcccagcattttgggaggccgaggcgggtggatggcctgaggtcaggagttcgagaccagcctgaccagcatagtgaarccccatctctactgaaaatagaaaaattacctgagcgtggtggcgggtgcctgtaatcccagctactagagagggtgaggcaggagaatcacttgaacctgggagacggagggttacagtgagccgagattgtgtcgttgtactcctgcctgggcaacagagcgagactccatttcaaaaaaaaaaaaattatatacaaatcgttatgcagtgttttcctttatagtatgcgctggacattttttcatttcagtgtacttcaatttgcatcattactctttttttttttttagtactgca

SEQ ID NO: 205353 - DNA, 601 bp, Human
ctatcacaaagatagtttaaatatggttacttataaatgtcatgactatctcacaatatgtcttcagccagaaaatgagactatatataatttagcacagtgtgcaacttatgcttagcattcaataaaatgcttcttatcataaatgaatattcttattttaatcctgatcatttcataccatttatttgctgattagagttgtttttcagtcaatgattttcaaattgcagcacacataggcatcactggataatgctttttattagacgtacttagtttagcgatagtccattaaacrtttttataatacctttgtattatccttgcctggagagttctgttcccagattgtcacctggctgtctctcatcattcaggttttaactcaaatgtcatgtcctccaagaagccttcctatctccattcattttgtatcttcttgccctgttttttctcttgtatggtagagtgtttttttttttttgtatggtagagtgtaagctccatgagagcagaggtcttgtctgttttgttcatgttggagctgcagtgcctagagcaatactaaataatactatgctcaaaaaatatttgtggc

SEQ ID NO: 205354 - DNA, 601 bp, Human
acgtttttataatacctttgtattatccttgcctggagagttctgttcccagattgtcacctggctgtctctcatcattcaggttttaactcaaatgtcatgtcctccaagaagccttcctatctccattcattttgtatcttcttgccctgttttttctcttgtatggtagagtgtttttttttttttgtatggtagagtgtaagctccatgagagcagaggtcttgtctgttttgttcatgttggagctgcagtgcctagagcaatactaaataatactatgctcaaaaaatatttgtrgctgagtgcggtggctcatgcttgtaatcccagcattttgggaggccaaggcagaaggatcccttgagcccagaagtttgagaccagtctgggcaacatagtgagatagtgagaccctgtccctacaaaaaaaattttttttttagttagctgggcatggtggtacacacctatagtctcagctactcaaaaagctaaggtggaaggattgcttgagcatgggagatggaggctgcagtgagccatgattgtgccactgcactccaacctaggcaacaaagcaataccctgtttccaaaa

SEQ ID NO: 205355 - DNA, 601 bp, Human
tctgttttgttcatgttggagctgcagtgcctagagcaatactaaataatactatgctcaaaaaatatttgtggctgagtgcggtggctcatgcttgtaatcccagcattttgggaggccaaggcagaaggatcccttgagcccagaagtttgagaccagtctgggcaacatagtgagatagtgagaccctgtccctacaaaaaaaattttttttttagttagctgggcatggtggtacacacctatagtctcagctactcaaaaagctaaggtggaaggattgcttgagcatgggagatsgaggctgcagtgagccatgattgtgccactgcactccaacctaggcaacaaagcaataccctgtttccaaaaaaaagatatatgtgtatatatatatttgtgagttgtacaagaggctagcaacaagcctttccctggtttaattttgcttcagttattggagacttaagcattgacagttactgtttattctgttttttttttcttaaagtagcatattttaattaacagatgcacatagtaaattaactttctgatgcaacagtcttattataatgcatttcatacttctttctccct

SEQ ID NO: 205356 - DNA, 601 bp, Human
aaaggttaaatttttcattaaggtctgttgattcccatgcgatccttctcaccttgcttaattctgataccaatcttttcttaattttaggcatacagagccaacagtaattatttttaagttactttcaattagttttcagttgtaattttgtcacctttgtttttaatcatgtaggcattggggcatgtcggtctgatctggagaaaaaaaattctctaggatcaaagacaggacagtcacttgatttctctggcatatgagaagtgctgttcctcaagccaaacatttaattgttggrattttatgttggagcaagtaaagatcttaagcttacttcatctgtttaaagagatttaagacaactgccctttttccttgtactcaaaaccagtcttagtgatttgttttactgtggaaaaactggtttgcttaatctaactaaacattttagaatgagtagtaattttgtaaccatcatgccacactcctctttctcataaattcttgtgtaacaaaagtgtgggacagggaatgacaaatgtgactttatttttttaacaaatgtaagttttcagttcttttttttaaatttttaatt

SEQ ID NO: 205357 - DNA, 601 bp, Human
ttgttgaatatgacataattttctgcttgaggctgagtagtattccattgtgtgtatatgccatatttatttcatctgtttatccattgatgggcatttcaattgtttccatatcttagctattgtgaatgatgcagatgctacagcgtagttcacctttgttttgagagagggagagagagagacagagacagagagagagagagaaaaggcctcactctgttactcaggctggagtgtactgatgcaattatagctcactgcagcctcaaacctatgggcttttgagatcctcccatcrcagcctcttagctacaggtgtgtaccaccatgcctagctactttaaaaaaaattcttttggctgggtgcagtggctcacacctgtaatctcagcacttggggaggctgaggcaggaggatcacctgaggtcgggccaacatggagaaaccctgtctctactaaaagtacaaaattagctgggcgtggtagtgcatgcctgtaatcccagctacttgggaggctaaggtaggagaattgcttgaacccgagagatggaggttgcggtgagccgagatcgtgccattgcactctagcctggg

SEQ ID NO: 205358 - DNA, 601 bp, Human
caaacctgattttatgctaatgaggtggctcttggaggatggcttctggttgccagaggaatcaaccatgtggttatctctaaggtgggacttttcagcctacctcccccttatttctgaggagggcagaggggcctggagatggagttaatcaccagcagccagtggtttaatcagtcttgcttaggtaatgggacccccttaagaactcaaaatgtaggggttcagagagcttcctgctcggtgaacaaatcaaggtcctgggagggtggtacatctggacccggcttggaagctctgygtccccccgtaccttgtcccattacctcttcatctggctgttcatttgtatcctttataatatcctttataataaagtgtttttgtagcaaattgtttaacatgaggagggggttgtgggtgtaggggccagggaaaagcttccccattgatctccaaaggtttgctgaaaaatcaactcacaagaggcagattaattggagaaaagtcatacagattttattacatgtacacgggggaaccacagagattactcaccccccaatggggttcggaagcatgtataatatcctggcaaaac

SEQ ID NO: 205359 - DNA, 601 bp, Human
acacctgtaatcccagctactagggaggttgaggcaggagaatcacttgaacctgggagctggaggttgcagtgagccgaggtgtcaccaccacactccagcctgggtgacagagtgagacttggtttgaaaaaaaaaaaaaagctagactccacattctttaaaaaaaaaaaacaactttgctaagatataattcaccaatgtaaagtgtacaattcattggtttttagtataatcacagagttgtgcagctgttatcaccatcaattatagaacattttcattaccaacccccccccccaaaaaaaaatctcgtgtctattagcagttgctacttgtttcccccctacccctttctctgcaggccccagacctagacaaccactaatccacgatatgtttctacagatagactgattctagacatttcctatacagtgtcattactaattccttttatgggtggataatattccattgtatggatatacatattttatttatccatttatcaattgatggacaattggctattgtgagtaatgttgctacgaacatttggttacaactttttgtgtgaatatgttttcatttcatatgg

SEQ ID NO: 205360 - DNA, 601 bp, Human
aaagattggccgggtgcggtggctcacgcctgtaatcccagcactttgggaggccgaggtgggtggatcctgaggtcaggagatcgataccatcctggctaacacagagaaaccctgtctctactaaaaatacaaaaattagccaggcgtggcggcgtgtgcctgtagtcccagctgctggggaggctgaggcaggaaaatggcatgaacttgggaggcggagcttgcagtgagccgagattgcgccactgccctccagcctgggtgacagagcgagactccgtctcaaaaaaaaaaaaaagaaattaggaaagataccctgttggttgaatgaatgtatgtgtcataactcttttggaggacagttggaaatacttggccaaattttaaatgggcagactttttttgttaattttttactttaattttaatggatacatagtaggtgtatgtgtttatggggtacatgagctattttgatgcaggcatacagtgcataatcatgttgcgtaaatgggatattcatcacctcaagcatttatcatttatttgtgttacaaatattccaattatactcttttagttatttttaaatatacaa

SEQ ID NO: 205361 - DNA, 601 bp, Human
gtaggtgtgtgtttagttttctgagaaatctctatactgttctccatagtgactgtactaaagtacattcccaccaacagcatgtgagggttcccttttctgcatatcctttccagcatttgttattgcctctcttttggataaaaaccattttaactggaatgagatgatatcttgatgtagttttgatttgcagttccctgatgatcaatgatgttgaacaccctttcatatacctgtttgccgtttgtatgtctccttttaaaaatgtctgttcaggagccgggcacagtggctcacscctgtaatcccagcactttgggaggttgaggtgggcagatcttgaggtcaggaaatcgagaccatcctggctaacatggtgaaaccccgtctctactaaaaatccaaaaaattagccgggcgtggtggcgggtgcctatagtcccagctactcaggaggctgaggcaagagaatggcatgaacctgggaggcagagcttgcagtgagccgagatcgtgccactgcactccagcctgggcgacagagcaagactccatctaaaataaaaaaaaatgtctattcagggctagggatggtgtc

SEQ ID NO: 205362 - DNA, 601 bp, Human
cgcctgtaatcccagcactttgggaggttgaggtgggcagatcttgaggtcaggaaatcgagaccatcctggctaacatggtgaaaccccgtctctactaaaaatccaaaaaattagccgggcgtggtggcgggtgcctatagtcccagctactcaggaggctgaggcaagagaatggcatgaacctgggaggcagagcttgcagtgagccgagatcgtgccactgcactccagcctgggcgacagagcaagactccatctaaaataaaaaaaaatgtctattcagggctagggatggtgkctcacgcttgtaatcccaccactttgggaggccgaggcgggcggatcacttgaggtcaggagttccagaccagccaggccaacatggtgaaaccctgtctctactaaaactacaaaaattagctgggcatggtggcacgtgcctgcaatcccagctacttgggaggccgaggcagtagaactacttgaacccaggaggcagaggttgcagtgagccaagattacgccactgcactccagcctgggtgacagagcaagatccgtttccaaaaaaaaaaaaggaaaaatgtctattcatatc

SEQ ID NO: 205363 - DNA, 601 bp, Human
ttttgctttgattacctgtgattgcggggtgctactcaagaattacttgcctggaccagtgtcatggagagtttccacagttttttcttttagtagttgcatagtttgaggttttggatttaagtctttaattcattttgatttgatttttgtatatggcgagaaataggggtctagtttcattcattcttctgcatgtggatatcttgttttcccagcactatttattgacagtcttatttattgaaggctgtcttttccccagtgtatgttcttggcacctttgtaaaaaatgagttcrctctagatgtatggatttatttctgggttctctcttctgttccatcggtttatgtgtctgtttttatgccagcaccatcctgctttggttactacagtttgtagtataatttaaaggcatagaatgtgatccctccagttttgttctttttgttcaggctagctttggccattctgggtcttttgtggttccatataaatttacaatgatttttttctatttctgtgaagaatgttattggtattttgatagggattacactgaatctgtagattgctttcagtagtatggacattttaa

SEQ ID NO: 205364 - DNA, 601 bp, Human
gtgtctgtttttatgccagcaccatcctgctttggttactacagtttgtagtataatttaaaggcatagaatgtgatccctccagttttgttctttttgttcaggctagctttggccattctgggtcttttgtggttccatataaatttacaatgatttttttctatttctgtgaagaatgttattggtattttgatagggattacactgaatctgtagattgctttcagtagtatggacattttaacagtattgattcttccaatccatgaacatggaatatctttccttttttttttttaatgtgtatgtcttcttcagtttcttgtatcagtattttatgattttcattgtaaagaaagagatctttcactttttttttttttttttttttgagacagagtttcacttttgttgcccaggctggagtgcaatggcacgatctcagctcactgcaacctccacctcccgggttcaagtggttctcctgcctcagtctcccgagtagctgggattacagggatgcaccaccatgcctggctaattttgtatttttagtggagacgaggtttctccatgttagtcaggctggtctcgaact

SEQ ID NO: 205365 - DNA, 601 bp, Human
ctttatttctttctcttgtctcattgctctagcttggacttccattactatgttgaataatagtggtgaaagtgggcatccttgtcttgttccaaatcttagagaaagactttcaattttctcccattcagtatgatactaggtgtgggtctgtcttatatggcttttatcgtgttgaggtatgttccttctatccccagttttttttggatttttgtcatgaagggatgttgaattttaccaaatgctttttttagcatcaattgaaatgatagtatgatttttgtcctttattctgttrtatcatgttttattctgttctatcatgtgatatatcacgttgattgatttgcatgtgttgaaccatccttgcatccctggaacaaattccagttggtcatgatgaatgatctttttaatgtgttgttgaattcagtttgctagtgttttgttgaggatttttgcatcaatgttcatcagagatattgacctgtagttttctctctttttgacatatttgtctggttttagtaatactgatgagtattactgggtcttagaatgagtttgaaactattccctcctcctccatattttggaa

SEQ ID NO: 205366 - DNA, 601 bp, Human
cttgttccaaatcttagagaaagactttcaattttctcccattcagtatgatactaggtgtgggtctgtcttatatggcttttatcgtgttgaggtatgttccttctatccccagttttttttggatttttgtcatgaagggatgttgaattttaccaaatgctttttttagcatcaattgaaatgatagtatgatttttgtcctttattctgttgtatcatgttttattctgttctatcatgtgatatatcacgttgattgatttgcatgtgttgaaccatccttgcatccctggaacarattccagttggtcatgatgaatgatctttttaatgtgttgttgaattcagtttgctagtgttttgttgaggatttttgcatcaatgttcatcagagatattgacctgtagttttctctctttttgacatatttgtctggttttagtaatactgatgagtattactgggtcttagaatgagtttgaaactattccctcctcctccatattttggaatattttgagtaggattggtattagtttttctttaaatggcactgaagccattggatcctgggcttttctttgctgagagactttt

SEQ ID NO: 205367 - DNA, 601 bp, Human
actttcaattttctcccattcagtatgatactaggtgtgggtctgtcttatatggcttttatcgtgttgaggtatgttccttctatccccagttttttttggatttttgtcatgaagggatgttgaattttaccaaatgctttttttagcatcaattgaaatgatagtatgatttttgtcctttattctgttgtatcatgttttattctgttctatcatgtgatatatcacgttgattgatttgcatgtgttgaaccatccttgcatccctggaacaaattccagttggtcatgatgaatratctttttaatgtgttgttgaattcagtttgctagtgttttgttgaggatttttgcatcaatgttcatcagagatattgacctgtagttttctctctttttgacatatttgtctggttttagtaatactgatgagtattactgggtcttagaatgagtttgaaactattccctcctcctccatattttggaatattttgagtaggattggtattagtttttctttaaatggcactgaagccattggatcctgggcttttctttgctgagagactttttattatggcttcgatctcattac

SEQ ID NO: 205368 - DNA, 601 bp, Human
tcatgatgaatgatctttttaatgtgttgttgaattcagtttgctagtgttttgttgaggatttttgcatcaatgttcatcagagatattgacctgtagttttctctctttttgacatatttgtctggttttagtaatactgatgagtattactgggtcttagaatgagtttgaaactattccctcctcctccatattttggaatattttgagtaggattggtattagtttttctttaaatggcactgaagccattggatcctgggcttttctttgctgagagactttttattatggcttygatctcattacttgttagtactctagtcaggctttggatttcttcatggttcaatcttggtaggttgtatgtgtctaggaatttatccatttcttctaggctttctgatttgttggcatatagttgctcatcgtagcctctaatgatcctttgagtttctgcagtattagttgtattgtctcctttttcatctgtgatttgatttctttgggtcttgtatcttttatttttagtccggttaaaggtttgttgatactatttgtcttttcaaaaaaatcaagtttacattttgttgatctt

SEQ ID NO: 205369 - DNA, 601 bp, Human
tgcatcattagtttgttcatttagcgcctttctcctttttttgatgtgggcacttattgcttgctataaactcacctcttagtactgctttcactgtatcccattggttttggtagtagttgtgtttctattttcatttttttcaagaaatttttcaatttttttcttaattttgtattgaccccctggttaataaggggcatattgttaactttcatgtgtttttgtagttcccaaagtccatcttgttactgatttctagttttgttccattgtggtcagagaagatacttgttagttkttgtaggttagtaacaatatttggattatactaaggagtttttatctagagttatagagattttcttagaatgctgccatggtagagaataagtgggtgggtatataggggaaaacaacattttgaaatatgtttcaaattttccagattaaacagttaaaaagaacaggtggtgaacctagagaatagtgttttagaaaccgagacacaggatttcttaatagtgggcaactttgtcagggactgcaagagagatcacctagaataaggactgaaaagatgtcataggtttcagcagct

SEQ ID NO: 205370 - DNA, 601 bp, Human
tttgttcatttagcgcctttctcctttttttgatgtgggcacttattgcttgctataaactcacctcttagtactgctttcactgtatcccattggttttggtagtagttgtgtttctattttcatttttttcaagaaatttttcaatttttttcttaattttgtattgaccccctggttaataaggggcatattgttaactttcatgtgtttttgtagttcccaaagtccatcttgttactgatttctagttttgttccattgtggtcagagaagatacttgttagtttttgtaggttartaacaatatttggattatactaaggagtttttatctagagttatagagattttcttagaatgctgccatggtagagaataagtgggtgggtatataggggaaaacaacattttgaaatatgtttcaaattttccagattaaacagttaaaaagaacaggtggtgaacctagagaatagtgttttagaaaccgagacacaggatttcttaatagtgggcaactttgtcagggactgcaagagagatcacctagaataaggactgaaaagatgtcataggtttcagcagctggtttcatgac

SEQ ID NO: 205371 - DNA, 601 bp, Human
gagtgtttgggctaaaacctggcagcagcattttgagaaatgtgtggaaggtaagaacatggagaaaggatatgatcactatgtgaaaaaaagttgtttcattataaaagattacaaacttatgatttttaaaatattaaagagaagtatgaagtgaaaaaaaaccctgccccttttcctttctcatcttctcacctgtttcctccagttttagtctctagttttactcttgagatttgtggctactgaatgaatggagtgtcaatctgaatgggaaagagaattttttttttttttttttgagacaaagtctcgctcttgttgcccaggctggagtgcaatggtgtgatctcggttcgctgcaacctccgcctcccaggttcaagcgattcgcctgccttagcctcctgagtagctgggacaacaggcacgtgccaccacgcccagctaatttttgtgttttcgtagagacggggtttcaccatgttggccaggctggtctcaaactcctgacctcaggcgatccacccaccttggcctcccaaagtgccgggattccaggtgtgagccactgcacctggcctgaaagaggtttttgaga

SEQ ID NO: 205372 - DNA, 601 bp, Human
agattacaaacttatgatttttaaaatattaaagagaagtatgaagtgaaaaaaaaccctgccccttttcctttctcatcttctcacctgtttcctccagttttagtctctagttttactcttgagatttgtggctactgaatgaatggagtgtcaatctgaatgggaaagagaattttttttttttttttttgagacaaagtctcgctcttgttgcccaggctggagtgcaatggtgtgatctcggttcgctgcaacctccgcctcccaggttcaagcgattcgcctgccttagcctccygagtagctgggacaacaggcacgtgccaccacgcccagctaatttttgtgttttcgtagagacggggtttcaccatgttggccaggctggtctcaaactcctgacctcaggcgatccacccaccttggcctcccaaagtgccgggattccaggtgtgagccactgcacctggcctgaaagaggtttttgagagggagactcagaaacgcctttgcctgagaagagctaggaaatagaaggaaagaaaaaaatggaacagaggagctcagagaagataaaaggaagtagggatgcagtggt

SEQ ID NO: 205373 - DNA, 601 bp, Human
ccttttcctttctcatcttctcacctgtttcctccagttttagtctctagttttactcttgagatttgtggctactgaatgaatggagtgtcaatctgaatgggaaagagaattttttttttttttttttgagacaaagtctcgctcttgttgcccaggctggagtgcaatggtgtgatctcggttcgctgcaacctccgcctcccaggttcaagcgattcgcctgccttagcctcctgagtagctgggacaacaggcacgtgccaccacgcccagctaatttttgtgttttcgtagagayggggtttcaccatgttggccaggctggtctcaaactcctgacctcaggcgatccacccaccttggcctcccaaagtgccgggattccaggtgtgagccactgcacctggcctgaaagaggtttttgagagggagactcagaaacgcctttgcctgagaagagctaggaaatagaaggaaagaaaaaaatggaacagaggagctcagagaagataaaaggaagtagggatgcagtggtcaagtgggagaaaaaaaaggagaggcactcttttctttgagtagccaggaaaaaatgactttg

SEQ ID NO: 205374 - DNA, 601 bp, Human
atcactatgatgcccaggctggtctcaaactcctgtgctcaaagagtcctaccacctgggcctcccaaagtgctgggattagaggtgtgaaccaccatgcccagccaagaacctcttaatatactgcatttaattgcaatatattgacagtatttcgttgaacatttttgagagctatgagaccagacttaggaatcttctaaaaaagtgaaacgaatgtaaatctttccttaagtataatgaatcatttcagtgccttattattatttctttgtattttcctttacagtgtttttttttwaaaaaaaaaaaaaaaacagtggtttgattttatcttttatttgagacacagtttcactctgttgcccaggctagagggcagtggcacagtctcaactcactgcaaccttggcctcctgtgttcaagtgattctcatgcctcagcctccaaagtacttgggattacaggcgcctaccaccatgcccagctaatttttgtatttttagtagagatggggtttcaccatgttggccaggctggtctcgaactcctgacctcaggtgatctgcctgccttggcctcccaaagttctgggattac

SEQ ID NO: 205375 - DNA, 601 bp, Human
ctaatttttttttttgtatttttagtagagatggggttttgtatttttagtagagtgctagccaggatggtctcaatctcctgatcttgtgatctgcccacctcggcctcccaaagtgctgggattacgggcgtgagccaccgcgcccggcctaaactttcaattctgtattaagctatcctgagatttctaattgagagcattgcaactggtctttagtatcttaattttaaatagtaaacccattgctatatttgctttaaaatatgactttgggaacctgttgtaatctttctatggkattaactattactgttattaccattactgtgggatgttattattaatgactaatagacaatatataaaataatgatggacttaaaaatatgaaggtggactagatttgatcgtttggaacctctttctctaactatatttgagaaacatattaatataaagaccactggatgaaaagttgttggggaaaaagatatgcttctggtacaaaatatcactttacagattagttacaaagactgaaatgtacctttacaatgaagagatctagcagtcactacctttaatggttattgaacat

SEQ ID NO: 205376 - DNA, 601 bp, Human
ttgtttttgtttttgttgtgggctgacagttgacaccgtgacaaagggaattgagtcagcaaactatttgggaaatggttatgaccttcttggttaataaaatattgttgaattactcttttcagcgtgctcactgtgccatctgcacagaccgaatatggggacttggacgccaaggatataagtgcatcaactgcaaactcttggttcataagaagtgccataaactcgtcacaattgaatgtgggcggcattctttgccacaggtaagatgtctgtccttttttttttttttttttttaagagcgtgcttgataacactgctataacagagtgctaaaatagggaggtgttcaggaattacagcacaacagagtagctacagagtatggggaggaataccttacgttactgttaacacaccgtgaactttggaacttcgaaatatctgtggtaatacttgtctgtgggacacagttaacttctttacctgctgtaaaatcctctggtctaaattaggaagctatagagagaaccatttaagagttttttccccctctcctttaatctgaacgtattagtttatagctcacattattct

SEQ ID NO: 205377 - DNA, 601 bp, Human
tctcggaggatcacgggtcccttagagaagtgatgaaagctttgaggactctgtagatactgtgcatgtacatacgggcatacacctttgcccccagttgtagaagtatggactgcctgaagttcacccaaggacccagattgagaacccctgtttgagactatcaaattaatagctttatgaaaaatgtgagtttaagttagacaggaacttttacaattgtgtcttgggctcagatgttttaaagtggtacttcagttcatttttcaaatttgttcctaaaatcactgggagaaaaaawtatgttttaatatgaatttttgtgtttccagttgtaaatgtagaacttaaatatggttgaatcaaatgacttattttttatttaattttagattttactctgcagaaatcagtctagcattaaattatcttcatgagcgagggataatttatagagatttgaaactggacaatgtattactggactctgaaggccacattaaactcactgactacggcatgtgtaaggtgaggaaaattttctagttattttaaaaggtcttcagcagctagtagtctttgtaaaataacttcatgttta

SEQ ID NO: 205378 - DNA, 601 bp, Human
tttgcttttatgtacagaattcaaccgtacttttcacatgatacttattaattaattattgttgttttttttttttggagacagagtctcgctctgtcgtccaggctggagtgcaatggcacaatcttggctcactgcaacctccgcctcctggattcaagccgttctccagcctcagccttccaagtagctgagattaaggtgcgccccaccatccctggctaattttaattttttttttttttttttaatttttgagacagagttttgctcttattgcccaggctggagtacaatggcrcaatctcggctcactgcaacctccacctcccaggttcaagcaattctcctgcctcagcctcctgagtagctgggattacaggcacctgccaccatgcccggctaatttttttgtatttttagtagagacggggtttcaccatgttggccaggctggtcgcgaactcctgacctcaggtgatccacccgcctcagcctcccaaagtgctgggattacagatgtgagccaccatgcccggcccttacgtatttatattatacaagttttcaatcataaacaattagaaagcttagcgagtgg

SEQ ID NO: 205379 - DNA, 601 bp, Human
attaactgtatctcaggcacccgaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtttaagaccaaggaggcaggagaatggcgtgaacccgggaggcggagcttgcagtgaaccgagattgtgccactgcactccagcctgggcgacagagtgaaactctgtctcaaaaaaaaaaaaaaagcccctgtccacacctccagcagttgccaacatatagccgggcgcggtggctcacacctgtaatcccagcactttgggaggccgaggcaggcggatcacgaggtcaggaaatcgagaccattctggctaacatggtgaaaccctgtctctactgaaaacacaaaaaattagccgggcgtgttcacaggtgcctgtagtctcagctactcgggaggccgaggcaggagaatggcgtgaacccgggaggtggagcttgcagtgagccgagattgcaccactgcactccagcctgggcgacag

SEQ ID NO: 205380 - DNA, 601 bp, Human
ttgcttaagcccgggaggtcaaagctgcagtgagctgtgattgcatcactgcactccaacctgggcaacagaacaagcccctttcaaaaaagaagaaaaaagattaaagccatgtaaaagttaaatataatactataatttttatctttctagttattttggaaaaacaaattcgcataccacgttctctgtctgtaaaagctgcaagtgttctgaagagttttcttaataaggtataaattgtgtataagaatattttgtgatttgtctctttctatatatatcaaactggtcagtagcrgtttgggaaatgtaaaattccaaaacagtagagaatgtaactttttcagtttgacccagaatttgtctcttacccaaagagtaattgacagcattagatcctgagataagttagttgtcctttccattttggcaataaaatttactccccagctatatattacataatttttgtgtatgtgtaaataatatataccatattctcacataggggaagagttaatctttgggtttagccataattgtactttgaactctgtttccattttctctgtatcattatccatagaatctatttatt

SEQ ID NO: 205381 - DNA, 601 bp, Human
tgctgggattccaggggtgagccaccatgcccagccaaaaaattgaatattaatgtaataaagcaggttgtaatgttattaaggcccatatcaatgtttatacttgtttttatttttttaggagaaacagtctcagtccgttgcccaggctgtagtgtagctcacgacagccttgattgaactcctgggcttaagagatcctcctgtgtaacctcccaagtagctgggactacaggcataagccatggtacccagctaattttcaattttttttttttttttttttgagatggtgtcttgytctgtctcccaggctggagtgtagtggcacaatctcagctcactgcaaccttcgccacctgggttcaagcgatttctcctgtctcagcctccagagtagctgggattacaggtgtgtgccaccacacctggctaatttcggtatttttagtagagacggggtttagctatgttggccaggctggtcttgaatccctgacctcaggtgatctgcgcaccttggcctcccaaagtgatgggattacaggcgtgagccactgcacccagccaatttttaatttttttatagagatgggatctt

SEQ ID NO: 205382 - DNA, 601 bp, Human
tgagccaccatgcctggcctgttgttactttatagatgtggaaaataagacatcatggttaagtaacttgcccaaggtcacacaggtagagctatcaatagcagactggaaccaatagaggccctcacagaatgattcttgggagatttcagttttcatctgaactttctcagggggatgtaataatgtaaatggactcttggcccctccatcctggaagcttggccaagtggcctaaaccaggggtccccatttagtttctccagcccccttttttcttgctgagttgttttaaaagttraaaagtgcttagtgaccttggacaacattagcaccttctaagtcctggaatccaccaagaaggaggaagggagatggtgctgaattcccctaaggcagggctcaggaagcaagagaaccctgtggtctaacctttcccatctgctctcttgttcccaggctacgtgcaggcctgccgcgccctgatgattgctgcctcggtcctgggtctgccggccattttactgctgctgactgttcttccctgcatccggatgggccaggagcccggtgtggctaagtacaggcgggcccagctggc

SEQ ID NO: 205383 - DNA, 601 bp, Human
atggttaagtaacttgcccaaggtcacacaggtagagctatcaatagcagactggaaccaatagaggccctcacagaatgattcttgggagatttcagttttcatctgaactttctcagggggatgtaataatgtaaatggactcttggcccctccatcctggaagcttggccaagtggcctaaaccaggggtccccatttagtttctccagcccccttttttcttgctgagttgttttaaaagttaaaaagtgcttagtgaccttggacaacattagcaccttctaagtcctggaatccrccaagaaggaggaagggagatggtgctgaattcccctaaggcagggctcaggaagcaagagaaccctgtggtctaacctttcccatctgctctcttgttcccaggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggtaagacagctttctcagtggtaccctacct

SEQ ID NO: 205384 - DNA, 601 bp, Human
agcttcccaggtgatgcttatgtgcaggcaagactgagcagctcagttaataaagaaggaggccgaggtgggcggatcacctgaggttggaagttcaagaccagcctggccaacatggtgaaaccccatctctactaaaaatacaaaaattagccaggtatggtggtgcatgcctgtaatcccagctactcggggcgggggttgctaaggcaggagaatgatttgaacccaggaggcagaggttgcggtgagctgagatcacgctactgcgttccatcctgggtgacagagtgcaactccaaaaaaaaaaaaaaagaaaaagaaaaagaaaaaagaaagaaagaaaaaagtaaagaagagggcaagagaaaagtcaggagttgagggtggttagaccaccaggtgatggctccgtcctttaactcagtaagccttccttgagcatgtgggccagacaccatggtaggtactggggacactggggaaaataggccgtctttgctttgagtgtacttggaaacctcaatagaatatggtatgtgctcatgtagaaaaggtatatagtctgtgcatacacataggaaggcacctaacccagact

SEQ ID NO: 205385 - DNA, 601 bp, Human
tgctaattgaaatcagtttttcctgaccctgaaaatctgtaattatttttgtgaaagcttaaaaaaattatgtctgttgtacaactttatcttctcagcagttacgtttgatggtgtgaggatttggttcctgctgtggaggaagaaataggagccagttgcttctaaagccagatgagtagtacaggagcagcaggctctcagatctgtggtggatttgaggctaatctgtttgtggcttttcaagagtccctgccaaggcaggaggtgcctgtgccctgaattgtgtgatcttatcagytggagtcagatccaactgtgctgaatctggaacctactactttctagctgtgtgaactggggcagttccttaatgtctctggtcccttccataaaatgggaacaataacgcctgcttctcaggttagtaaaaacagtgaaatgatgtgtgaaaattatttagcataggatctggcacatggtaagtgctcaataaatggttgctattattattgttattgttggttagctggttaaaagaatacccagagagcagctgggtattcttccaatcatgtcaatttccttctttttattttta

SEQ ID NO: 205386 - DNA, 601 bp, Human
cacttacatttcattgctttaaaatggacttctcaaatattttctgtttggtcacatcaccatcattcttagtttttaacaaggcatatcttatcaattaaagaatgtattgtgttgcattatttgaaacttgttctcaaaaggggcaaacaattttattctttgaagagcaaggaattctgcttatgagaggaccaggtttagatatatctgtctttacatagtgaagctttcttttcccttccctttctctcccttctcttcccccttctcctccttctcatttttagctaagaatatrcctcagttttactttctgttttccaacaacaaatggtaccccccaccaccttgtgtagttagctgttgcatcttctgaaggtaaaaaaggagaaaaactgaaaaatctgagtgctaaaattactctgtcttgtttttagagacttaatttaaaaataaactctgatgatataaaaagaaaaagaacaaaaattccctttgtctgtcttcaattttcttgaccttacaggtaactgactttctagaaaaacactttctttatttttcccaaataacagagagaaccattccaaactcatct

SEQ ID NO: 205387 - DNA, 601 bp, Human
atcttatcaattaaagaatgtattgtgttgcattatttgaaacttgttctcaaaaggggcaaacaattttattctttgaagagcaaggaattctgcttatgagaggaccaggtttagatatatctgtctttacatagtgaagctttcttttcccttccctttctctcccttctcttcccccttctcctccttctcatttttagctaagaatatacctcagttttactttctgttttccaacaacaaatggtaccccccaccaccttgtgtagttagctgttgcatcttctgaaggtaaaaraggagaaaaactgaaaaatctgagtgctaaaattactctgtcttgtttttagagacttaatttaaaaataaactctgatgatataaaaagaaaaagaacaaaaattccctttgtctgtcttcaattttcttgaccttacaggtaactgactttctagaaaaacactttctttatttttcccaaataacagagagaaccattccaaactcatctttttgggtttgcgaataaaattaaaactatcaggccttctgtgtctttaagaaaggcaattatttttggccagttatattactattt

SEQ ID NO: 205388 - DNA, 601 bp, Human
aaattactctgtcttgtttttagagacttaatttaaaaataaactctgatgatataaaaagaaaaagaacaaaaattccctttgtctgtcttcaattttcttgaccttacaggtaactgactttctagaaaaacactttctttatttttcccaaataacagagagaaccattccaaactcatctttttgggtttgcgaataaaattaaaactatcaggccttctgtgtctttaagaaaggcaattatttttggccagttatattactatttcacatttttaaaagttaagtaatgatttgwcttgaatttttaactttactggtcaaaacatatctctttctctcttgaaaccattgctgaaattgagtaaattctccttttttagtttttaaacatttctcattttgggttcaattgaaggtcactgttttcagtgagcctctcatttcctttcatgttgtgtggcagtctgtcattttttagtggttttgatgtggttcatctttgagagccacaggaattccacccagggttcatttgtctcctaggaagtaaagagcctgctggcactcatttgccttgttttgtgtgaattgtaag

SEQ ID NO: 205389 - DNA, 601 bp, Human
ttagagacttaatttaaaaataaactctgatgatataaaaagaaaaagaacaaaaattccctttgtctgtcttcaattttcttgaccttacaggtaactgactttctagaaaaacactttctttatttttcccaaataacagagagaaccattccaaactcatctttttgggtttgcgaataaaattaaaactatcaggccttctgtgtctttaagaaaggcaattatttttggccagttatattactatttcacatttttaaaagttaagtaatgatttgtcttgaatttttaactttaytggtcaaaacatatctctttctctcttgaaaccattgctgaaattgagtaaattctccttttttagtttttaaacatttctcattttgggttcaattgaaggtcactgttttcagtgagcctctcatttcctttcatgttgtgtggcagtctgtcattttttagtggttttgatgtggttcatctttgagagccacaggaattccacccagggttcatttgtctcctaggaagtaaagagcctgctggcactcatttgccttgttttgtgtgaattgtaagagaaggaaatctttaatga

SEQ ID NO: 205390 - DNA, 601 bp, Human
aatctcagtgtgaaagttaggttaacaatagatgtggggaatgctttcctgcatgtgtgtgcacatgtgctgtatgtgtaaatacaaagtatagttgaaaaatataaaacttgatttgaaccctgagttgttttgaaaccagttaattgtttataggaaagatcggttagattgaaccatatcagttgtttgggaattagaacttttttctctacagaattcagcttttcactccccttctttttcctctaaacaagcctgggtgtttggaagcctttgctaggttgctgttttttgcccrcagcagaacgaatgcccacttttgaggtttagggctgtgtaagtagattgtgtattgctacggaaaatctacagtagttctctctggctgaaacactccagaagaggattttagtcccttttgctgacagagaaaaaggtttttctctgtgtcttgctgaaagtagagactctgataatagccaagcaattctccaagagtgcctgatttggagttcacgccagagaagagaaagaaaaagactttcccctgcatctgaggtttccaaagtcctgagctagaaagggaggtttcacgtac

SEQ ID NO: 205391 - DNA, 601 bp, Human
ctgaaagtagagactctgataatagccaagcaattctccaagagtgcctgatttggagttcacgccagagaagagaaagaaaaagactttcccctgcatctgaggtttccaaagtcctgagctagaaagggaggtttcacgtacacactgcttttcttgaacattctagtcacagaaggaaaatacatcttctcatggtatctcatatgaaaatattacagaagctggcatgactgtgcttactttttaagaaaaaggaagcattagcatatggatagattttagcttcttctttttctctttttttttttttgacacagaatcttgctttgttgcccaggctggagtgcagtggcaagatctccgctcactgcatgcaacctctgccttctgggttcaagcaattctccctgcctcagcctcctgagtagctgggattacagtcacccaccatccatgcctggctaatttttgtatttttttgtagagatggggttttgccatgttggccaggctgatcttgaactcctgacctcaggtgattcgcccaccttggcctcccaaagtgctgggattaaaggtgtgagccaccatgcctggc

SEQ ID NO: 205392 - DNA, 601 bp, Human
gacacagaatcttgctttgttgcccaggctggagtgcagtggcaagatctccgctcactgcatgcaacctctgccttctgggttcaagcaattctccctgcctcagcctcctgagtagctgggattacagtcacccaccatccatgcctggctaatttttgtatttttttgtagagatggggttttgccatgttggccaggctgatcttgaactcctgacctcaggtgattcgcccaccttggcctcccaaagtgctgggattaaaggtgtgagccaccatgcctggccaattttagcttgttagataatctataaataattaatggagtgaatttgggctgttagaaagccaatctgggcaattcatagcttttcaaattaactctcttccttctgatttcctcttgagatctattctttttaaggatagaaatcatatcttcctacatatatctatacccagcttgtgggggtgggcttaatctattgtcaataaaaatctatgttacaagcaacacaaatgcgatgagattgtttaaaaggtctttcaaaatgggtaagaccaatcttttttccatttagaactaatatacaaggctg

SEQ ID NO: 205393 - DNA, 601 bp, Human
tgttacaagcaacacaaatgcgatgagattgtttaaaaggtctttcaaaatgggtaagaccaatcttttttccatttagaactaatatacaaggctgttagatttgattgcttatgttaagttatatttcttctctgtgggcatagagagtaagttagaaaatcacttactatgagtagaaatcagaaaaaagcttgctgagttgaaagtgataacggtacccctggtggcaaacatcagactggcagtgcagtatctgtcttgaatttgttgatggaaacctcattgttattattattgktattattatttttctgtctgccaactttaatgtgccatctcaacttaaagaggtttggagttactttgtttagagctgtgttgttcggtacagtagccactagctacatgtggccatttaaattaaaattaatgaaaattcaaaattcagttcttcatctcactagcctcatggcaaatgatcaatggtcccacataacttgtggccactccatttgacagtgctggtctagagatttgaaaaaagtaaaaaaaagtctttatagcctcttgcctgcccatgttttgttactttgcttat

SEQ ID NO: 205394 - DNA, 601 bp, Human
gaggtggctgccatcttgtttctcatatttgaatagctcagatcattcagccattcaactggtctacattgagcacatactatttgccttgtaccaaggtagacataggtaagacatggaccctaccttcaaagaactcagagcttagaatgatgcatagacatgtaaaggggtaattataatacaattaagtaagaatactaattttagaattataactgtagatatgaagtgttgatatacaagtaaatacaaataaatattttttggacttaaatggtttatttctaggtttttacaytggaattgttttgtctctgttacctgctgaaaaaaataaggacccagcagtctacttcttctacagatgccaactgctacatattggttcagtgttgagggagcagaactgtgtgtatggagctttttggagctggttggaagccacaagtgtgtgtatgtggagtgagtgggcctgcccaagtgcttggtgtgtgatggttgcgcccagtcaccgcctctccatgtctctccagctctctgcgcccttgttgccaccatctggttccctgtgtgcgcccaccgtgagaccaccatcgtg

SEQ ID NO: 205395 - DNA, 601 bp, Human
aatggacagtaaagaaataatgtaggccacgggccgagatgaaaactgtcctttttatttaaagctataacaatcatctgaagccagccctgcaaaatgacagccattgaaaaaggcatgctagttcttttgcctttttctgtacttggtcgcctgtgtccctaaacagacctcttctcggcagggtttgctcagcaagtcacttgatgagtcttgcagtctacagagacaggtggggactggtggggatggcggggtgagaggggaggaggagggtgagcggtccaggtgaggagggggkcagttgaaggtgaaagcagacaccgagacggtgataaggccgcagtctcttcctagatcaggaccacgcgacacctgactgcgccctggccacgagcacgatccgacccgtccgccgcagggacccggaccgcgaaaatgtccacaggcttcgacgccacatagtaaaaaaaagtacacatataacatttacaggggctcaaactgccgctgcctcctctccggagcggtccggcctgccggccgcggttccctctcgatgcttcagggaaccaggacagaaaggtccttccgctagctg

SEQ ID NO: 205396 - DNA, 601 bp, Human
ttccaatttcaaattctcaactgtgaaataaagggctgttttatttggctgctgccagctcaaaatgacacattgcaccatgtgtggcatttgggccctgtttggcagtgatgactgcctttctgttcagtgtctgagtgctacgaagattgtacacagaggtccagatacattccgttttgagaatgtcaatggatacaccaaaaacaagatgttttaattaaaacatctctaacttgaaaaataactattttggtgttttttttaaaaaaactgcgaattgcagcaaatgcccaaatartttgggataaacaccctaaggaaaaaatatacattcaagttgcataagtcactttgagctattctttgatgatatttcatttatatctaaaagaaccaaaggtttagctggcttttccggaaaaccagaaccaaataatatatggttagaatgaaaatcatctcaagcaatttggaaatgaagtaccacatgtcctatgctgtctcttccatgcacttgaccaaatagcccaaatagcctataacaaattatttgagatttactggaaaaattccataagatttaaatgagatgactact

SEQ ID NO: 205397 - DNA, 601 bp, Human
aatgcaggctggctccaacctagccagagatcctagccccactctcaccatcccaaaatccctcaaagatccaacagactttccagattactagagtctcctctcaggttcccttgacagttaaatgccctctttatctgaactagctgcaggtaccatataatgggtacaacagaaaatcatactgctgtaagtgtaaaagatacgcagctctttcaagcatttcactatattacatctaggttaccttcaagtgatttattcagatgtgattgaagaaaatctaaagggaaaaaaaaaacaatttaatttgatatcagatatcctggctttataacaaataaaacatttcaagttaatagaagatacaaaatattcactatcaaaatgtcctcactgacaaaaatgttctcaaatatttctgtctcaaagttgcattgttcagtaaggaagcaaagtaggtgagacatatacaccaacaacatccctaataaaaaacttagctcatccctataagcccggaagcaaataaatcacccttacatacgttaattactttccaatttcaaattctcaactgtgaaataaagggctgttttat

SEQ ID NO: 205398 - DNA, 601 bp, Human
tgacagcgtccatgccacatctgtctctgcattctaagtttgcttccaagatacagatacaaatgcaggctggctccaacctagccagagatcctagccccactctcaccatcccaaaatccctcaaagatccaacagactttccagattactagagtctcctctcaggttcccttgacagttaaatgccctctttatctgaactagctgcaggtaccatataatgggtacaacagaaaatcatactgctgtaagtgtaaaagatacgcagctctttcaagcatttcactatattacatcyaggttaccttcaagtgatttattcagatgtgattgaagaaaatctaaagggaaaaaaaaaacaatttaatttgatatcagatatcctggctttataacaaataaaacatttcaagttaatagaagatacaaaatattcactatcaaaatgtcctcactgacaaaaatgttctcaaatatttctgtctcaaagttgcattgttcagtaaggaagcaaagtaggtgagacatatacaccaacaacatccctaataaaaaacttagctcatccctataagcccggaagcaaataaatcaccct

SEQ ID NO: 205399 - DNA, 601 bp, Human
tttacttacaggtattcggaaaagatagtgacctctacattcaaccggctacagcagcttagcacctagccaaagcctgcatctctcccaccttaggatttagtggttggctagagctgacagcgtccatgccacatctgtctctgcattctaagtttgcttccaagatacagatacaaatgcaggctggctccaacctagccagagatcctagccccactctcaccatcccaaaatccctcaaagatccaacagactttccagattactagagtctcctctcaggttcccttgacagttwaatgccctctttatctgaactagctgcaggtaccatataatgggtacaacagaaaatcatactgctgtaagtgtaaaagatacgcagctctttcaagcatttcactatattacatctaggttaccttcaagtgatttattcagatgtgattgaagaaaatctaaagggaaaaaaaaaacaatttaatttgatatcagatatcctggctttataacaaataaaacatttcaagttaatagaagatacaaaatattcactatcaaaatgtcctcactgacaaaaatgttctcaaatatttct

SEQ ID NO: 205400 - DNA, 601 bp, Human
gcagttggtgtatccattgacattctcaaaacggaatgcatctggacctctgtgtgcaatcttcatagcactcagacactgaacagaaaggcaatcatcactgccaaacagcgcccaaatgccacacatggtgcaatgaagctataagctttctatggagagaaaagcagacaaatcaaaaatattcaatatccaatccaactctgcattaaatcttgattccggaaacgtgcataaaccacttcaaagactaaaatttaaaccatcttttctatagcgatttcccattaggttggcaggyacatgggagtagagaatgatttaatttacttacaggtattcggaaaagatagtgacctctacattcaaccggctacagcagcttagcacctagccaaagcctgcatctctcccaccttaggatttagtggttggctagagctgacagcgtccatgccacatctgtctctgcattctaagtttgcttccaagatacagatacaaatgcaggctggctccaacctagccagagatcctagccccactctcaccatcccaaaatccctcaaagatccaacagactttccagattactagagtc

SEQ ID NO: 205401 - DNA, 601 bp, Human
gatttcaccattgtaacagagccacaaatacggatatttcttcactcgaattggctgcattccaaacagcgggtcaactaccgccaaccggtgaaatccaaagcagcagttggtgtatccattgacattctcaaaacggaatgcatctggacctctgtgtgcaatcttcatagcactcagacactgaacagaaaggcaatcatcactgccaaacagcgcccaaatgccacacatggtgcaatgaagctataagctttctatggagagaaaagcagacaaatcaaaaatattcaatatccartccaactctgcattaaatcttgattccggaaacgtgcataaaccacttcaaagactaaaatttaaaccatcttttctatagcgatttcccattaggttggcaggcacatgggagtagagaatgatttaatttacttacaggtattcggaaaagatagtgacctctacattcaaccggctacagcagcttagcacctagccaaagcctgcatctctcccaccttaggatttagtggttggctagagctgacagcgtccatgccacatctgtctctgcattctaagtttgcttccaagatac

SEQ ID NO: 205402 - DNA, 601 bp, Human
tctctacttttacaaatataacatttggctaatttagaatagaaattaattattttcaaaatatttaacttcttgtaactttttaataaaagaaataacactgttcaagtgaaacagggcacttcctatttcatttaaggggaaagccaagctgataatgccataataccacctagcgttctcatgtatatgacattatttgacttagaaaaaatttttaatactctcttcttctacctcccactagcaggaaattccattcttgcctttccttttcaccatttcatctccaatcacctaraaaaatgatgtctggtgcatagtagacccttaataaaggaataaagaaatgtgtaaaaggaatttcctgaataactattttaaaactttttaaatgagaagactattattaagagtcttcctatgagcaggcaacaaacaatgacaaaagctattgttcacagataaaaatgtccaaaatgtgattaggatgtaaatctctatcaatgcctgacaggtatctatcaagaagtctcaaaaaataccaagaaacataccaaccaaatgcatgaaccttgaatgaaatctggctcaaaacaaa

SEQ ID NO: 205403 - DNA, 601 bp, Human
accactgaactgtatacttcaagtgggtgaattacatggtatgtgaattatcaataaagctgttttagaaatcctaacacttgctgtgctataactgcgcaaagtaccacaatgcaataattgcagagtcaaccctacgattatagtatgacacaggaaaacttaaaactgcacttaagatcaagctagatgtagagcatattagcacagcaaaaaataaacgactgcactaaagaatcatccttcaaggattacagaatttaagtgctgaaaaggagagtacaactcctctgtttttttwaaaaaaggtaaagactcataacttagtcacttgtaaaattctggattgctctctaagagattttcaaatataatttaaaagaaaacgtacaaccaagacaataatgaaaatctatagaaaaatttattattacctttagcttctgaacatacagccaaaaatccatcttctgtcattgctttaaacaaaggtctgactccatatgtatctctacccaggaacactttcttattggcagtatccagtaaaacaaatgcaaacacaccatccaacatacaaattgtttgctcaattcctcct

SEQ ID NO: 205404 - DNA, 601 bp, Human
gaggcagggtgttgtggtgcatgcctatactcctagctactagggaggctgaggtgggagaatcgcttgagcccacgagttcaaggctgcactgagctatcaaaccaccgcactccagcctgggctgggcgactgagcaagaccccatctcttcaaacaaacaaacaaacaaaaacctagttgatcctgccagcaaaaactaaggtaaagggcataggatttgatttggttttttttgaggtggaaaaacaatcctaaaactgattggagtgttgtttaccaacatctgtgaatatactamaaaccactgaactgtatacttcaagtgggtgaattacatggtatgtgaattatcaataaagctgttttagaaatcctaacacttgctgtgctataactgcgcaaagtaccacaatgcaataattgcagagtcaaccctacgattatagtatgacacaggaaaacttaaaactgcacttaagatcaagctagatgtagagcatattagcacagcaaaaaataaacgactgcactaaagaatcatccttcaaggattacagaatttaagtgctgaaaaggagagtacaactcctctgttttt

SEQ ID NO: 205405 - DNA, 601 bp, Human
gctggagtgaataaaaaatgatgcagccatttcaaaaattagtctggcagttcttcaactgaacatagttatcatgtgtcccagcaattctactcctagatatacacccaagggaaatgtccacacaaaaacttgtacaccaatgtttatagcagcattattcataatagccaaaaggggtaaataatgtcctaaatgtccatcaactgacaagcgaataaacaaaatgcagtgtatccatgtaatggaatatcatttggccataagaagtaagtactgatacatgctacggcatagacawatcttgaaagcactataccaagtgaaagaatccagtcacaaaagccggtatgatatataatcccgttcatatgaaacatacagaatagggaatccagaggcagaaagactggtgattgccggggctacaactgcaggggtgcagctgatggatatggagagatggaattcaaagctaaagggcacaggaggcagggtgttgtggtgcatgcctatactcctagctactagggaggctgaggtgggagaatcgcttgagcccacgagttcaaggctgcactgagctatcaaaccaccgcac

SEQ ID NO: 205406 - DNA, 601 bp, Human
catttctttcaacaacattttatagttttcagagtacaagttttacacttcttaaatttatttctaagtattttattctttttgatgctattataaatgaagttgctttcttaatttcattttgattgctcattttaagtatgtagtattcagttaaagtgtgtcaaataccattgatttttgtatattcatcttgtatcctgcaaccctgatgaacagaagggatttgtatctagaatacataaggaactattacaattcagtaataaaaagacaaaataactcaattagaaatgggtarttcaagaatggataaacaaattgcattgcatgcaaacaaatggaatattattcagcaagcacaccaacatggcacatgtatacatatgtaacaaacctgcacgttatgcacatgtaccctagaacttaaagtataataataataataataaatgagctatcaagccatgaaaaaacacagaagaactataaatgtatactgctaggtgaaagaagccagtctgaaaaagctacatactatatgattacaactattatacgacattctgggaaaggcaaagtgagagagaaagcaaaaaga

SEQ ID NO: 205407 - DNA, 601 bp, Human
tctcatttctttcaacaacattttatagttttcagagtacaagttttacacttcttaaatttatttctaagtattttattctttttgatgctattataaatgaagttgctttcttaatttcattttgattgctcattttaagtatgtagtattcagttaaagtgtgtcaaataccattgatttttgtatattcatcttgtatcctgcaaccctgatgaacagaagggatttgtatctagaatacataaggaactattacaattcagtaataaaaagacaaaataactcaattagaaatgggtagttcaagaatggataaacaaattgcattgcatgcaaacaaatggaatattattcagcaagcacaccaacatggcacatgtatacatatgtaacaaacctgcacgttatgcacatgtaccctagaacttaaagtataataataataataataaatgagctatcaagccatgaaaaaacacagaagaactataaatgtatactgctaggtgaaagaagccagtctgaaaaagctacatactatatgattacaactattatacgacattctgggaaaggcaaagtgagagagaaagcaaaa

SEQ ID NO: 205408 - DNA, 601 bp, Human
tccttctgtcagtattatattgtccttattaccattgtcttgtagtaagttttaaaatcagttaatatgaggtctcctactttgttcctcattttcaaaagattgttttggctattcttagtctcttgcaattccatatgaatttgagagtcagcttgtagatttcacaaagaactcatctgggattctgatagggatcaagttaaatctgtaaatcagtttagggaggactgccatcttaacaatgttaagccttcaaatcatgatcatgggatacttttccatttattcagatctcctytcatttctttcaacaacattttatagttttcagagtacaagttttacacttcttaaatttatttctaagtattttattctttttgatgctattataaatgaagttgctttcttaatttcattttgattgctcattttaagtatgtagtattcagttaaagtgtgtcaaataccattgatttttgtatattcatcttgtatcctgcaaccctgatgaacagaagggatttgtatctagaatacataaggaactattacaattcagtaataaaaagacaaaataactcaattagaaatgggt

SEQ ID NO: 205409 - DNA, 601 bp, Human
ccatttttctgtatccataatttttgtatacgatgttgggtaaagattcaactccaagttttgcatatggttacatatctggttgcccctgtgccagttttcaaacttctttctccactgaataatcttggcacccttgtcaaaaataagttgatcatatatgtatgggttcatttctgactctcaattctatcccactagtctatacatctatccttctgtcagtattatattgtccttattaccattgtcttgtagtaagttttaaaatcagttaatatgaggtctcctactttgttcytcattttcaaaagattgttttggctattcttagtctcttgcaattccatatgaatttgagagtcagcttgtagatttcacaaagaactcatctgggattctgatagggatcaagttaaatctgtaaatcagtttagggaggactgccatcttaacaatgttaagccttcaaatcatgatcatgggatacttttccatttattcagatctcctctcatttctttcaacaacattttatagttttcagagtacaagttttacacttcttaaatttatttctaagtattttattctttttgat

SEQ ID NO: 205410 - DNA, 601 bp, Human
ccagcagtcctggcaactgacatatatatatgcttgttctttgccatctgatcacactagaaatgcctgaaaataagccagttccagtattagtacaaacactgtgactagtgtcctaaggacccctttgattgatctcattatccctgcttcagccaatattaaatctgaaaattaagtgagaaagaatttaaagaatggcaaaaagaggcagggagagagatattaggatgttactgctgtacaggtaagggataaaagataaatgtcttcctcaagtttaccatcaaaaagtgctatrcatgatttgcaagtattttcttccaacttgtgggccgtcttttcactttcttgatggtgtcctttgatgtgcaaaaatgtttaattttgatgaagtccaattcattgatttttattattgttgctggtctcatatttaagaaagctttgccaaatccagggtcatgacaatttacttctatgtttgcttctcgggattttatagttttagcccttacatttaagtggattagttcaaaactgattcatttgatccttttttttttttttttttttgagatgagtctcgctctgtcactca

SEQ ID NO: 205411 - DNA, 601 bp, Human
tattccagatgagataatttggtctggaaaaggacagtgtcaaggatatagaaaagaacaattaaggaatttcagagggtaagttccatatcaagtgatcatcaggctcaaagaaggcccaggggagcaggaggctgcttttccccagtgttctctttaccaggctttcccagcagtcctggcaactgacatatatatatgcttgttctttgccatctgatcacactagaaatgcctgaaaataagccagttccagtattagtacaaacactgtgactagtgtcctaaggacccctttgaytgatctcattatccctgcttcagccaatattaaatctgaaaattaagtgagaaagaatttaaagaatggcaaaaagaggcagggagagagatattaggatgttactgctgtacaggtaagggataaaagataaatgtcttcctcaagtttaccatcaaaaagtgctatgcatgatttgcaagtattttcttccaacttgtgggccgtcttttcactttcttgatggtgtcctttgatgtgcaaaaatgtttaattttgatgaagtccaattcattgatttttattattgttgctggtctc

SEQ ID NO: 205412 - DNA, 601 bp, Human
ttgtctacccagccagtaacctgtgtagcactgaattcaaataccagaaaaaggacccagattccctcaccagccagcagagctcaagtgagctacacaacccggatagggaatggggagtaattaaaaggttttaagcaggcaatactataatcagatgagattttgacaggttattctaaaagcactgagaaaagaaaattgttgcagtattccagatgagataatttggtctggaaaaggacagtgtcaaggatatagaaaagaacaattaaggaatttcagagggtaagttccatakcaagtgatcatcaggctcaaagaaggcccaggggagcaggaggctgcttttccccagtgttctctttaccaggctttcccagcagtcctggcaactgacatatatatatgcttgttctttgccatctgatcacactagaaatgcctgaaaataagccagttccagtattagtacaaacactgtgactagtgtcctaaggacccctttgattgatctcattatccctgcttcagccaatattaaatctgaaaattaagtgagaaagaatttaaagaatggcaaaaagaggcagggagagag

SEQ ID NO: 205413 - DNA, 601 bp, Human
taaatttcctcaataaattctcacagacagtacagtacccaacctctcatcaccatgatctttgatacaaacatcaatgttttattgtagatcgtaatggactatctacatggaatactcgtgatttacaatttgagattgtctacccagccagtaacctgtgtagcactgaattcaaataccagaaaaaggacccagattccctcaccagccagcagagctcaagtgagctacacaacccggatagggaatggggagtaattaaaaggttttaagcaggcaatactataatcagatgagwttttgacaggttattctaaaagcactgagaaaagaaaattgttgcagtattccagatgagataatttggtctggaaaaggacagtgtcaaggatatagaaaagaacaattaaggaatttcagagggtaagttccatatcaagtgatcatcaggctcaaagaaggcccaggggagcaggaggctgcttttccccagtgttctctttaccaggctttcccagcagtcctggcaactgacatatatatatgcttgttctttgccatctgatcacactagaaatgcctgaaaataagccagttc

SEQ ID NO: 205414 - DNA, 601 bp, Human
tcagaacacagccatggttcccagacctttaacaagtacaatgatccacttttacctactttaaagtcagataagaagacatctatcccttaactagttgttatacactatatgtgaataaaaccatataacttaaatttcctcaataaattctcacagacagtacagtacccaacctctcatcaccatgatctttgatacaaacatcaatgttttattgtagatcgtaatggactatctacatggaatactcgtgatttacaatttgagattgtctacccagccagtaacctgtgtagcrctgaattcaaataccagaaaaaggacccagattccctcaccagccagcagagctcaagtgagctacacaacccggatagggaatggggagtaattaaaaggttttaagcaggcaatactataatcagatgagattttgacaggttattctaaaagcactgagaaaagaaaattgttgcagtattccagatgagataatttggtctggaaaaggacagtgtcaaggatatagaaaagaacaattaaggaatttcagagggtaagttccatatcaagtgatcatcaggctcaaagaaggccc

SEQ ID NO: 205415 - DNA, 601 bp, Human
gatacctttattcaaattaggtaacccttcccaataactttcacgattagttaacatcatctacattcctattttccctttttaatacaaacacatacccattaaataagcaaaataggaaaaaaaattttctattttcctaagccctaccatctacttacctgagagacaataatggcacagggatatactgccaaattacactaacttttcgtaattcaaagaaatagaaaaatctccagtgttcaatttcttcttcttagatttctaatcaagaaaacctattttctatactaaagcmaatacacaaaaggaaaagacacacttatgaagcaaagggatgaactggagtcctaatgttatgataggctgggagtcatttatttgtcatcactgaggtattttcagaacacagccatggttcccagacctttaacaagtacaatgatccacttttacctactttaaagtcagataagaagacatctatcccttaactagttgttatacactatatgtgaataaaaccatataacttaaatttcctcaataaattctcacagacagtacagtacccaacctctcatcaccatgatctttg

SEQ ID NO: 205416 - DNA, 601 bp, Human
ccatttccacggatgcaactttgccatttggctttaaatccaaaacttcatagtgtccaggaagaaaaggctccacttttaaaaagggagtcgcggagtgcttcaatgtaacaagacctagaaattcacaatgatacctttattcaaattaggtaacccttcccaataactttcacgattagttaacatcatctacattcctattttccctttttaatacaaacacatacccattaaataagcaaaataggaaaaaaaattttctattttcctaagccctaccatctacttacctgagagrcaataatggcacagggatatactgccaaattacactaacttttcgtaattcaaagaaatagaaaaatctccagtgttcaatttcttcttcttagatttctaatcaagaaaacctattttctatactaaagcaaatacacaaaaggaaaagacacacttatgaagcaaagggatgaactggagtcctaatgttatgataggctgggagtcatttatttgtcatcactgaggtattttcagaacacagccatggttcccagacctttaacaagtacaatgatccacttttacctactttaaa

SEQ ID NO: 205417 - DNA, 601 bp, Human
gaaggaaagagtaaatcatacagtaaatattttatagtaaaaaccaaagggatggctacaaatcatttcaattaaacacacatgaaatataattaggtttttttaattgacttcacctgataaaaggcagccaatccttctgtctgtcatcaaacgtttctttacagcattattaaaaaggatcctgaggttgttcttcacagtttctatctcaaaacctataaacacagcagtaaatcaaacagctccagaaaatcttgggctggattagttattgaaatgaaatacacaatcatcaacrtctatcatgatggtatttactcaatggtggagtgtgccaaatcttaatgtgttccctccaaacaaaataggaagtaggtcttgaaactaaaatcattcaaatgatgggagaatacaacttaaaatttttttcccttggagaaggatggggaataggtgggtgggtgtctgctacctggaaagagtttctccacattgtcatagagggcgtgcaggggttcatcccgacagtgatgatatttaaccatttccacggatgcaactttgccatttggctttaaatccaaaacttcatagtgtc

SEQ ID NO: 205418 - DNA, 601 bp, Human
tcaacttcaacaagagaaaaatatataaactgtgataatagtagtatttgaattggttaaaaatcactacacagaattctaaagaacattcactgactcactcttaacaccaataacatagctatagtgtaactcaagttggagtatgactatgactattaaatacagcttataaaaaatcatttccatcctataatgaaggaaagagtaaatcatacagtaaatattttatagtaaaaaccaaagggatggctacaaatcatttcaattaaacacacatgaaatataattaggtttttttaattgacttcacctgataaaaggcagccaatccttctgtctgtcatcaaacgtttctttacagcattattaaaaaggatcctgaggttgttcttcacagtttctatctcaaaacctataaacacagcagtaaatcaaacagctccagaaaatcttgggctggattagttattgaaatgaaatacacaatcatcaacatctatcatgatggtatttactcaatggtggagtgtgccaaatcttaatgtgttccctccaaacaaaataggaagtaggtcttgaaactaaaatcattcaaatg

SEQ ID NO: 205419 - DNA, 601 bp, Human
atatccaacagccatttcattctattttaatacaatcaatttaaaacaattgacccagtcaatacagcagcagtagaatcacccattattgactccattttcattctaataacaagtctactctaactacactacacaagggacagagacagcaccttacctttctagcagccagtaaatcggggctgtcttccatgccaattgcaaatgtctggagaggatactgtacttgggcttctttcagctgcttcaacagagtggcagcaaccaagctggagtccaagccccctacatgcaaaaraggaagtggaagtgtcctagttatgtgccttgcataagacagggacagaagatgtatattcctgataaacaccaagatcatagttttactatttaaaatccgccaagttttataaactgaaatcaacttcaacaagagaaaaatatataaactgtgataatagtagtatttgaattggttaaaaatcactacacagaattctaaagaacattcactgactcactcttaacaccaataacatagctatagtgtaactcaagttggagtatgactatgactattaaatacagcttataaaaa

SEQ ID NO: 205420 - DNA, 601 bp, Human
aaactatggcttgaaataatttttttaaaccttacatttttttcagtattaaaaaaagctttttatttaagaatatcataataccttacctactgaagcacgaactgttgtaatgtcataagtttccaaggaaaatatgacttcatccagagcctgaatgccttcctcagagttaaaaaggacttcataatgttcacttccaatatgatctgccaccttattatataaagaaatacccatttacttgttaaagaaaataacttcccttgaaaatcaaacatgatgggagttcacaaagctytatgaattaacaatggtgaaaactaaacaagggaaaaaaagaaaaatgactttacagcccaccacatacaagccccatccagcactgttccctcgcctgcttcaactccaccaccaggaagtaagtctcccctcagctcctctggtgccaaggcttcaaccattctcccagttggcacctccctctctacctattttacctaacccacctcatctctctctagtccaacatggtcccacgctaagcttggtcttttttggtccttcttaaatgcctaattttatatccaggatgttattc

SEQ ID NO: 205421 - DNA, 601 bp, Human
cctcagggtcactacagcaccacatgggcatggtgggcactcactacttgtcacatgatgtttacgatctttacttctctttaaaacacttaacggtagctgctgtagcagccttgcctcttccatcttggttgttcagatgtgagcagaatgttgttaccctttaaaggtgaaaactccacctcaaacaacctatggaagaagacttctctccatataccacaacaccactttgaaatgtggcctaatccttttgggacaaagttaagaaacagcttcattttctctataaaagtcacastttgtaacatatagccaactatatgtaacatatagccaatcagctattgatttttattttctcagggtattgagctttttgttttgttttgtttttggtgtttttttgtttttgttttacaatagcctctaaaaatattacccatgggcagcagtagttcgatctgcgcggagaacatcaaacaaatagagttccctcagaagcctctcactctcctcctcggctttttcaggagaaggagcctatttcacaaacaaaaacaccaagagttttgcttttggcacacaaagcagtttttct

SEQ ID NO: 205422 - DNA, 601 bp, Human
gcattgatccacttgggcatccagtaatggctcagccagtcagcccggcctgggtaatggcgttcaaagacttgacggtagtaatatccttctttggttttaggagtattgaagggaaatttctgggctgcatttgccatcattgcatcatcaacctgtaagaataagcatataagagcaaaatggcttaaaatggcaggaaatacttgtgtttagtctcatttcacgaaacagaaaatgttaagacgtgactgtaacttgtatgagaccctttgaatcacccatcacttagaaaatgctraagtattcataatatggatagctgcagtgccttttaaagaacactcatatgcatatttttaatacttggtggctctgttttagtcatttgtgcctaacaagatctggcacccagcaggtgcccaaaaatctgataaatgaaaatcagtgatgattagtagtaagtctcctctctctctcgattctagatgctactttataatccttcatgctacttaattcttacgtaattcttacaaaagagataattgtttacagagactctgaatctctctgatagggacatcctatcagagagata

SEQ ID NO: 205423 - DNA, 601 bp, Human
ccacagtccccatccaacacgaagaaatatttgctttcacattacagcataaagaccacctaagctttgacagctgacttgtagtgggtcagcgtgcgggcagaagggtcagtggcattgatccacttgggcatccagtaatggctcagccagtcagcccggcctgggtaatggcgttcaaagacttgacggtagtaatatccttctttggttttaggagtattgaagggaaatttctgggctgcatttgccatcattgcatcatcaacctgtaagaataagcatataagagcaaaatggyttaaaatggcaggaaatacttgtgtttagtctcatttcacgaaacagaaaatgttaagacgtgactgtaacttgtatgagaccctttgaatcacccatcacttagaaaatgctaaagtattcataatatggatagctgcagtgccttttaaagaacactcatatgcatatttttaatacttggtggctctgttttagtcatttgtgcctaacaagatctggcacccagcaggtgcccaaaaatctgataaatgaaaatcagtgatgattagtagtaagtctcctctctctctcgattcta

SEQ ID NO: 205424 - DNA, 601 bp, Human
taaagcgatgctccacaaacttggacaactttctagtcgttctcacatcagtactttgggaaaatacaataagggtgaaatactagaaaaatgttcacgtgcttcgatgccatgtaatggtaaactgctataaaagttttcaaaatcttggcaatttctgctgcagacagcacgcgtttcccagaacgagggccacacgttaatattaccttagtgcagcgcttctcagagtgcccccacctgccgcagcagcagcagcatcaccacctgggtgggcgttcccccattactgaatcggagrctctgggggtggagcccaacaatctctaaaacaagtcctccaggtgattgtaatgtacgctgtagcttgtaaaccactgccttagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaatt

SEQ ID NO: 205425 - DNA, 601 bp, Human
taaactgctataaaagttttcaaaatcttggcaatttctgctgcagacagcacgcgtttcccagaacgagggccacacgttaatattaccttagtgcagcgcttctcagagtgcccccacctgccgcagcagcagcagcatcaccacctgggtgggcgttcccccattactgaatcggagactctgggggtggagcccaacaatctctaaaacaagtcctccaggtgattgtaatgtacgctgtagcttgtaaaccactgccttagagctgttggaggattaagtgatgtttaatctacayatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaattgtgtgactggcttattattaatcgaattagcagtttctgtttcctggtttccccatcatttcacctgctactcagccgtaaaagtttatttttgattcaaatgcagagattgagttttga

SEQ ID NO: 205426 - DNA, 601 bp, Human
actctgggggtggagcccaacaatctctaaaacaagtcctccaggtgattgtaatgtacgctgtagcttgtaaaccactgccttagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaatygtgtgactggcttattattaatcgaattagcagtttctgtttcctggtttccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatact

SEQ ID NO: 205427 - DNA, 601 bp, Human
tgtaatgtacgctgtagcttgtaaaccactgccttagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaattgtgtgactggcttattattaatcgaattagcagtttctgtttcctggtytccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaa

SEQ ID NO: 205428 - DNA, 601 bp, Human
tgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaaccccaaataatccaaaaactcttgttcagatttccaaactrgttcaaggtcaagatggaccaaaatttactttggctttatcttaaccaaagtcttcccaatcagtttcctaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaat

SEQ ID NO: 205429 - DNA, 601 bp, Human
atatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaaccccaaataatccaaaaactcttgttcagatttccaaactggttcaaggtcaagatggaccaaaatttactttggctttatsttaaccaaagtcttcccaatcagtttcctaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccaca

SEQ ID NO: 205430 - DNA, 601 bp, Human
tatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaaccccaaataatccaaaaactcttgttcagatttccaaactggttcaaggtcaagatggaccaaaatttactttggctttatcttaaccaaagtcttcccaatcagtttccyaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccacaaaaagtgtgtgaaatttagattgtggacg

SEQ ID NO: 205431 - DNA, 601 bp, Human
ctcttgttcagatttccaaactggttcaaggtcaagatggaccaaaatttactttggctttatcttaaccaaagtcttcccaatcagtttcctaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccacaaaaagtgtgtgaaatttagattgtggacgttccagtctccacttctgagccttgagaggttgctgaaagccctgactggctccagaaatgggcagtgttacctcttcagtgggtttcagtagctgtaaacttgaaacttaaggatttagtattgttctgaatgtggaattcacctccactgcaacttggatcctgtttaacaactcctcccttctctatattacctccatccatgtc

SEQ ID NO: 205432 - DNA, 601 bp, Human
gggttccttacagtcagaactgatcttatttccggtgaattattgtaattattgtaaaagtccaatatggtttggttttgtgtcctcacctaaatctcatttcgaattgtaattcccacctgttggaggaggggcctggtgagaggtgattgaaacatgcggggggtggactttccccttgctgttctcgtgagagtgaatgaattctcacgagatctgattatttaaaagtgtgtagcttgcccctttgcgctctctcgttctctcctgctcctttgtgtggagatgtgccagcttcctyttctgccatgattgtaagtttcctgaggcctccctggccatgctttctgtacaggctgtgaaactgtgagctaattaaacctctcttctttataagttaccttgtctcaggtagttctttatagcagtgtgaaaacagactaacacaaaggccgtctttcatgtggaacttgtttttgcgtattggaaacattgctaatctgtgtttgggaatgaatcttacctttttatagagtatcagtgggatcaggtgtttgggatttggagctgtcctttaaaataactttgacaagtttgattc

SEQ ID NO: 205433 - DNA, 601 bp, Human
ataacatgaattggcctactttgaatgatagattattattttacattgtaggtacagccagtgtgatcagacaaagcaattcgagaactacaaaagaggaaaaaagatcagaagttcttaaatacataagggaatgcagcatttgataaaggtggtatctcaagtcagtggggaaaaggtgaaatattcaataaatggtattgggacaactgggtagccatatggaaaaaaaggttggatctctacaccgtaagccaggataaatttcagtgtttgatggaataaattccagatatatgaygataatagctcacacttgttaagtgtcttgtatgccaggcactgtagtaatttactaatgcatttaatccttacggtaacccaaagaagtagtaactgttatcaccacttatagatgtggaaactgaggcccgtagatgttaggcagtttaaacaacatacattgctaataagtagtggagctgggatatgaacgtagtcagtttggctatagagttgctggccttaactcctatactctttttccatttaggttattgttaaaaatgaaacagtatgagaacagaatgtttttataatc

SEQ ID NO: 205434 - DNA, 601 bp, Human
atgcagcatttgataaaggtggtatctcaagtcagtggggaaaaggtgaaatattcaataaatggtattgggacaactgggtagccatatggaaaaaaaggttggatctctacaccgtaagccaggataaatttcagtgtttgatggaataaattccagatatatgatgataatagctcacacttgttaagtgtcttgtatgccaggcactgtagtaatttactaatgcatttaatccttacggtaacccaaagaagtagtaactgttatcaccacttatagatgtggaaactgaggcccrtagatgttaggcagtttaaacaacatacattgctaataagtagtggagctgggatatgaacgtagtcagtttggctatagagttgctggccttaactcctatactctttttccatttaggttattgttaaaaatgaaacagtatgagaacagaatgtttttataatctgggtgtgaggaaagccatgacttaaccatgacttgaaaatcggaaaacgtaagactgataaattagattatatcacagtaaaaagactgataaattagatcatatcacagtaaaattcttctgcatggcaaa

SEQ ID NO: 205435 - DNA, 601 bp, Human
ggaaaaggtgaaatattcaataaatggtattgggacaactgggtagccatatggaaaaaaaggttggatctctacaccgtaagccaggataaatttcagtgtttgatggaataaattccagatatatgatgataatagctcacacttgttaagtgtcttgtatgccaggcactgtagtaatttactaatgcatttaatccttacggtaacccaaagaagtagtaactgttatcaccacttatagatgtggaaactgaggcccgtagatgttaggcagtttaaacaacatacattgctaatragtagtggagctgggatatgaacgtagtcagtttggctatagagttgctggccttaactcctatactctttttccatttaggttattgttaaaaatgaaacagtatgagaacagaatgtttttataatctgggtgtgaggaaagccatgacttaaccatgacttgaaaatcggaaaacgtaagactgataaattagattatatcacagtaaaaagactgataaattagatcatatcacagtaaaattcttctgcatggcaaaaatcatcataagcaaagccaaaagacaaacgatggtaa

SEQ ID NO: 205436 - DNA, 601 bp, Human
catatggaaaaaaaggttggatctctacaccgtaagccaggataaatttcagtgtttgatggaataaattccagatatatgatgataatagctcacacttgttaagtgtcttgtatgccaggcactgtagtaatttactaatgcatttaatccttacggtaacccaaagaagtagtaactgttatcaccacttatagatgtggaaactgaggcccgtagatgttaggcagtttaaacaacatacattgctaataagtagtggagctgggatatgaacgtagtcagtttggctatagagttkctggccttaactcctatactctttttccatttaggttattgttaaaaatgaaacagtatgagaacagaatgtttttataatctgggtgtgaggaaagccatgacttaaccatgacttgaaaatcggaaaacgtaagactgataaattagattatatcacagtaaaaagactgataaattagatcatatcacagtaaaattcttctgcatggcaaaaatcatcataagcaaagccaaaagacaaacgatggtaaatagttgcaattcatatcataggtgaaggaccaatctttttaattat

SEQ ID NO: 205437 - DNA, 601 bp, Human
ccatatatccttatcttcaaggaagcatccttgaaatttgccctgctctaattccccttctcccggaaacccatcctttttctctccaacctaagtgatctccttcttctctactggacaaatagctatgtactactttatgaatcctttctatggcatcttgcgttgctaattagatgtcttattgcacggaactcgcacaatctgtctcatctccccacgtagtgagctcacagcacttcaccaagagtgctgcccaccaagaactcacagcacttcaccaagagtgcagtcaatagtsttttatgaacgttgggaagaatatggttaatgcctgagaacaaagaccagaaatgtcatcttttcgtgtgaccatcatgatacagagaagttaacagagctgccccattgtccatggggcatgttccgagtttttccagtagtggtgatagattttggctgatttctctgaacttttccctgagttatttttgtgactttggccaggatgaagggtggggaacccctcatctttaaatctctgagcagagacttgctaggcatctgcagcagtggtggggaagaggtcattaagctcagt

SEQ ID NO: 205438 - DNA, 601 bp, Human
cagaagggtaagagtctggccatggctttgctttcttctctcacgcttccaaccaccctcgtctgaaagctacatttcaccttgtgaaagttctgcccttctgtttccaaatacaagatgctgtaagcctgaactcagatctaaaaccaaacttagcattttgtttccaaaagattgactacatattttaatttcccaacctctctcagtggcactgctctcctctcaaatcccagaagccgcagtcagggtcatctttgagccttacctctacatttgagttgtccttcctcccatgagycccgatgacttcttttcttcattggtctctgatctgtcttcactctcccctgcctgagctgttcagagcattatcaacatctacctaaaatttgaatttcattctctcactgtttagggaacagcagcgacttggacctgtccaatgacactcttcaatgctggacacttgctgtaatttgctgctggcctcagtgtttcagatctccacttccaccccgaggctggctcctgctctgagctccttccttgcaggttgctatggtctgaatgcctatgtgcccctactgaattcatgttg

SEQ ID NO: 205439 - DNA, 601 bp, Human
aatacaagatgctgtaagcctgaactcagatctaaaaccaaacttagcattttgtttccaaaagattgactacatattttaatttcccaacctctctcagtggcactgctctcctctcaaatcccagaagccgcagtcagggtcatctttgagccttacctctacatttgagttgtccttcctcccatgagtcccgatgacttcttttcttcattggtctctgatctgtcttcactctcccctgcctgagctgttcagagcattatcaacatctacctaaaatttgaatttcattctctcrctgtttagggaacagcagcgacttggacctgtccaatgacactcttcaatgctggacacttgctgtaatttgctgctggcctcagtgtttcagatctccacttccaccccgaggctggctcctgctctgagctccttccttgcaggttgctatggtctgaatgcctatgtgcccctactgaattcatgttgaaatcctcacccccccaggtgatgggggattatgaggtgggggctttgggaggtgattagtcatgagggtggaacacgcatgagtgggattagtgcccttgtaaaagag

SEQ ID NO: 205440 - DNA, 601 bp, Human
tctgtcttcactctcccctgcctgagctgttcagagcattatcaacatctacctaaaatttgaatttcattctctcactgtttagggaacagcagcgacttggacctgtccaatgacactcttcaatgctggacacttgctgtaatttgctgctggcctcagtgtttcagatctccacttccaccccgaggctggctcctgctctgagctccttccttgcaggttgctatggtctgaatgcctatgtgcccctactgaattcatgttgaaatcctcacccccccaggtgatgggggattakgaggtgggggctttgggaggtgattagtcatgagggtggaacacgcatgagtgggattagtgcccttgtaaaagagaccccagataactagctagtcttttcggccatgtgaggacatggtgagaaggcgctgtccgtgaaccagaatttgggctctcaccagacactgaacctgctagcgctttgatcttggacttccagtctccagtattgtgagaaagaagctcctattattgataagctgccaggttatggtaaattgttatagcagtctggcggactgagacacaggatgttttt

SEQ ID NO: 205441 - DNA, 601 bp, Human
actgagacacaggatgttttttccttgcagccctgtctaaaacatcttggggctttcaaggctaaacttggcttcttccacttctctgccgccccttggggctgtttcagcttagattgctcttagagttggagctggaactagggctttggggctctgttttgtgctttcattccagtgtctctccttggggagatgaaggtagaatccctttcctgtatttggtgcttggtggtagtcatttcccccgctgtgttttcggaactcctagcctggttatagaagctgctggcatgatcaragttctcagattccagctgctttctcctggatatcctatcaaaatgccctctccgttcagtgagatactcgatgactttgactcatgatgccaaatgattgatttttccttcaccagagacctgcgtgtcctctgggtcagctggtacctcttctgtaagctcgggctcttatgaaaggggacataggcttttgcccaatttttttttttttaaaggcatggtttcttgtatttctgtaggaattttgtatcctttcatggaagtgcatctgtagtgtttctcagcagggtatattccta

SEQ ID NO: 205442 - DNA, 601 bp, Human
ttcttttcttttcttttttttgacacagtcttgctctgttgctgaggctggagtgcagtagtacgacgcctcctcacagcaacctctgcctcctgggttcaagtgattcttctgcctcagcctcccaagtagctgaggttacaggcacctaccaccatgcctggctaatttttagagattacccagagacgggggttcaccgtgttggccaggctggtcttgaactcctgacctcaagtgatctgcctgtctcggcctcccgaagtgctgggattacaggtgtgagccaccacgcccggcmccctgtacttcttttttctctttgccatgcttctgtttacccattactgccaacccatttgaccctccttgcttaggaattgctagcatttattttctttactactcatttggtatgcattcatattatttgaagacttcatatattgtctttttatttaagtttataatagtgattattgtatttctgttttctctataatggcattgcaaatttaatgagagcttatttacttatgtggatccctcccacacctaggcatgtctgttacatgatgaccattagttaaatgaactaaag

SEQ ID NO: 205443 - DNA, 601 bp, Human
ccacagccattgcatttgacaaccaaaagcttttgccaacaatgatgggcaaagagagggagggcgagagccaggcaccatggccaggtgggaaagtgtggagacctgcagatcctggcttctctttcaacagcttggctggaaataaggcaacaggttcaaaaggggtagggtttttaaagatgggagagactcaaaaatgtgtgtattctaaagggggaagatatgggaagatgttgaagaaaatctaaattttgtactactgtttgtcattttatacatggattctttttcactaccktctccttttttttttttttttttttttaaatgagacagagtctcactatgttgcccaggctggtcttcaactcatgagctcaagtgaccctccctcctgagtctctctgagtgttggaattacagccatgagtccccaggactggaccccttttgttttttattcctagttacttttctgctctttttcctctcagcctccctcactcttccctccctcgctcgctttctgaggcttctgacaactcatctattaataagtttcttacagtcctgtccttctggaagccctcagtgccac

SEQ ID NO: 205444 - DNA, 601 bp, Human
gggtcctgtaggctcactggggacccttggcgcagccccgttcacatggttgctgtggtgctggactggccactgggactctgccctcaggcaccagtgacccctgggggtgggtcatctgaccctttctggacagcgtctgcttcctgcagcttgtgtgcctgttttccagagatgggagctgtaaactgtgaaagtctagggctggcagctgccacggtgctgcaccctgcagaagatctgctttcagcaggagaggctgaggcccacgggaggaggcagaaatggtagctggtcccargctccttagctataaccatttttctgcccttcccatggcttcagtcttcagcgtttccttggattctttgaccaaaaacaaccagtctatctccctgtttctctttgcctctctttccttaaggcagtccaagttggaatattttcacctgcagctgaattaacatggatgccttccttatccttaacaaggtttgtcttgaatggaaaataaatggggatcacatttggagccagtggtccctcgctagcttttcatgtgagccacacttagaagccgtgctagggccgcaggcgtgct

SEQ ID NO: 205445 - DNA, 601 bp, Human
ctagcttttcatgtgagccacacttagaagccgtgctagggccgcaggcgtgctggacattcgtgttgttccagtattcaccgctgtgtgctggcaggatcctacctggaggttctggggactgcttccccatcccgcagagtttagcgttgcccgcaggctcataggtgtcaagaaccaggtgagagatagcacctggctcagcatatgatgtggtacttttttctttttttttaggcagggtctcactttgtgggccaggctggagtgcagtggcaggatcttggcttactgcagcctygacatcctgggcttaggtgatcctcccatctcagcctcccacatagctgggactaacaggcatgtgccaccatgcctggctaagtattttttgtagagacagggtttcgccatgttgcccaggcttgtctcgaactcgtgggctcaagcaatctgccttcctaggcctcccaaagtgctggacttacaggtgtgagccaccacacccgaccatgtttgttctagaaaaataaagctcattaattacaggaacatcgcagcttactgcctttctcactagcagccatgacgtgagctcctg

SEQ ID NO: 205446 - DNA, 601 bp, Human
tggaggggcctgctctgaggctgctggtgttcctttggtggtcagaacctggcatcccatagctgacttctataacccacgtgccatttgggcctcctgctccttggcttagtccctagttcgttaccatgggaacgtgaagctatccttaatatttctctaaattctggagtgtgtgtgtgactcggggagtttgtgttctcatgattacttccgcctcaaggttcgggcatctccagatgctacctctttttcacactgaattgactccttttcatttattttttgagttggagtcttrctctgtctcccaggctggagtgcagtggcgtgatctcagttcactgcaacctccgcctcccgggttgaagcagttctcctgtcttggtctcccgagtaggtggacttataggcgcccacaacgacgcctgacaaatctttgtatttttagtagagacggggtttcaccatattggccagactggtctcaaactcctgacctcaggtgatctgcctgcctcggcctcccaaagtcccgggagatgggattacaggtgtgagcccctacgcctggccaatgtaaaggaaattgagggggtac

SEQ ID NO: 205447 - DNA, 601 bp, Human
cctgctctgaggctgctggtgttcctttggtggtcagaacctggcatcccatagctgacttctataacccacgtgccatttgggcctcctgctccttggcttagtccctagttcgttaccatgggaacgtgaagctatccttaatatttctctaaattctggagtgtgtgtgtgactcggggagtttgtgttctcatgattacttccgcctcaaggttcgggcatctccagatgctacctctttttcacactgaattgactccttttcatttattttttgagttggagtcttgctctgtcwcccaggctggagtgcagtggcgtgatctcagttcactgcaacctccgcctcccgggttgaagcagttctcctgtcttggtctcccgagtaggtggacttataggcgcccacaacgacgcctgacaaatctttgtatttttagtagagacggggtttcaccatattggccagactggtctcaaactcctgacctcaggtgatctgcctgcctcggcctcccaaagtcccgggagatgggattacaggtgtgagcccctacgcctggccaatgtaaaggaaattgagggggtacccagattc

SEQ ID NO: 205448 - DNA, 601 bp, Human
gcactgtgttcactctatcaccttatccctggagcacccaccaaagtgccgtgaacagagtaggaattcaatcaatatttaccgaacgactagatgtgctcagcacggtgctaatggatgattagaaaagttaataatctcagctcttaaggagtttatagtctagtcaggaagccaaaaataacacagatgagaataattaagcctccaatctgatggcactgactgggggtgcatttatcaagaatttggaagcacgtaaccatacttacattctttgttgcatacatagcatttaaattgtgactctcatccaacttatcactcagatacatttttttctgtgttaaaaatataaagccatatttccagagatttttaaagggcccaaaagattatgaatttgatcttaacatcagcagatgacaatctagttttaacaagttactttgaattagtcaaatctaaaactcactttagatttgttttctggctaatattctaattgagagacatttccatggaggtattaggttaaaatactgtttttagatatgtgacacatttccctgtattttagaaatctcttgggtatcttaag

SEQ ID NO: 205449 - DNA, 601 bp, Human
taccgaacgactagatgtgctcagcacggtgctaatggatgattagaaaagttaataatctcagctcttaaggagtttatagtctagtcaggaagccaaaaataacacagatgagaataattaagcctccaatctgatggcactgactgggggtgcatttatcaagaatttggaagcacgtaaccatacttacattctttgttgcatacatagcatttaaattgtgactctcatccaacttatcactcagatacatttttttctgtgttaaaaatataaagccatatttccagagattttyaaagggcccaaaagattatgaatttgatcttaacatcagcagatgacaatctagttttaacaagttactttgaattagtcaaatctaaaactcactttagatttgttttctggctaatattctaattgagagacatttccatggaggtattaggttaaaatactgtttttagatatgtgacacatttccctgtattttagaaatctcttgggtatcttaagagaaatttaatccatctgattttgatccaaatataatttactcacaatgatggagaaatatttgatatccacggaaatc

SEQ ID NO: 205450 - DNA, 601 bp, Human
acacatttccctgtattttagaaatctcttgggtatcttaagagaaatttaatccatctgattttgatccaaatataatttactcacaatgatggagaaatatttgatatccacggaaatctattgatgcacttaaagtttttctccagggaaataagaaatcacattttttcaagggtgaatcataaacctacagtgtctaatttttctgcttatttaacaaaacctgagttaagtatcaaattgggcagttccagatcatttgtttttaagttttttagtcttttaaactatgcagagraaattttattcaaagaggtttttttttccttattctgacagttttatctgctatcctgtttttttccctaaacagtgatttttgaagatttaaggtaataacacaattttgatgtctgtggattaatggcgtctgtattcacgatgtttcagacctgtcagagcttggaaatagcatttaaatgtattgcttaattttaattttaaaatactttctctgagaattagatcccagtcctaagtgagtactttgaatttcaaagaggggatttaggccaaggtacagctaaattttgtcctc

SEQ ID NO: 205451 - DNA, 601 bp, Human
ctacagtgtctaatttttctgcttatttaacaaaacctgagttaagtatcaaattgggcagttccagatcatttgtttttaagttttttagtcttttaaactatgcagaggaaattttattcaaagaggtttttttttccttattctgacagttttatctgctatcctgtttttttccctaaacagtgatttttgaagatttaaggtaataacacaattttgatgtctgtggattaatggcgtctgtattcacgatgtttcagacctgtcagagcttggaaatagcatttaaatgtattgsttaattttaattttaaaatactttctctgagaattagatcccagtcctaagtgagtactttgaatttcaaagaggggatttaggccaaggtacagctaaattttgtcctcttgaaagacctgaaatccatttacaaataaaattgaggtcttcgtatcaatattatgttttggaagtgaaatgtgcaaggacttgtgcagtgtcacatcttaagaggctgttgggtgccatcgggagtcgaggcagggcctggcatttcagcgaccctgctgctccacatgctggttatggagtactctc

SEQ ID NO: 205452 - DNA, 601 bp, Human
acaaaacctgagttaagtatcaaattgggcagttccagatcatttgtttttaagttttttagtcttttaaactatgcagaggaaattttattcaaagaggtttttttttccttattctgacagttttatctgctatcctgtttttttccctaaacagtgatttttgaagatttaaggtaataacacaattttgatgtctgtggattaatggcgtctgtattcacgatgtttcagacctgtcagagcttggaaatagcatttaaatgtattgcttaattttaattttaaaatactttctctragaattagatcccagtcctaagtgagtactttgaatttcaaagaggggatttaggccaaggtacagctaaattttgtcctcttgaaagacctgaaatccatttacaaataaaattgaggtcttcgtatcaatattatgttttggaagtgaaatgtgcaaggacttgtgcagtgtcacatcttaagaggctgttgggtgccatcgggagtcgaggcagggcctggcatttcagcgaccctgctgctccacatgctggttatggagtactctccgacttgtccacgcttccaagttctgatt

SEQ ID NO: 205453 - DNA, 601 bp, Human
aggaaaatctgtgaggggtgggtgcttcgggcctctggtaggtcttagctagcctggggctcttcctgccctcctgtgggcctctgttttagccagacagcccactgatgactgccacatcctgagcattcctgcctttgggtttgttcttgagaatacccaccctattccacgtttctgatttccactcatcctcatggccccatttgagatgaacatcatctgtaaggcctccccagtgcctggctccaggcctctcttcttcctccaaactttgtcgtgctcaagaaagtgcctattstgtgtatttggcagtcatttcttgccacgtgatatctaataacttccatggatctgtcctgtttctgcaactggaagaagatgagcggaacctcttttaggtggggacagtgtcttagtcatctcaatagccccttgaaggcatgatacggtaccttggatggtttctatgttaatattttctgttatgtgtccatattgaggtatcatttatgtaccacaaaattcacctcttctaaagtagtggaatttgctttttaacaagtttgtacagttgtgaaaccatcaatgctgtccagtt

SEQ ID NO: 205454 - DNA, 601 bp, Human
gtgggtgcttcgggcctctggtaggtcttagctagcctggggctcttcctgccctcctgtgggcctctgttttagccagacagcccactgatgactgccacatcctgagcattcctgcctttgggtttgttcttgagaatacccaccctattccacgtttctgatttccactcatcctcatggccccatttgagatgaacatcatctgtaaggcctccccagtgcctggctccaggcctctcttcttcctccaaactttgtcgtgctcaagaaagtgcctattgtgtgtatttggcagtcrtttcttgccacgtgatatctaataacttccatggatctgtcctgtttctgcaactggaagaagatgagcggaacctcttttaggtggggacagtgtcttagtcatctcaatagccccttgaaggcatgatacggtaccttggatggtttctatgttaatattttctgttatgtgtccatattgaggtatcatttatgtaccacaaaattcacctcttctaaagtagtggaatttgctttttaacaagtttgtacagttgtgaaaccatcaatgctgtccagttttagaacactgtcatca

SEQ ID NO: 205455 - DNA, 601 bp, Human
tttagccagacagcccactgatgactgccacatcctgagcattcctgcctttgggtttgttcttgagaatacccaccctattccacgtttctgatttccactcatcctcatggccccatttgagatgaacatcatctgtaaggcctccccagtgcctggctccaggcctctcttcttcctccaaactttgtcgtgctcaagaaagtgcctattgtgtgtatttggcagtcatttcttgccacgtgatatctaataacttccatggatctgtcctgtttctgcaactggaagaagatgagcrgaacctcttttaggtggggacagtgtcttagtcatctcaatagccccttgaaggcatgatacggtaccttggatggtttctatgttaatattttctgttatgtgtccatattgaggtatcatttatgtaccacaaaattcacctcttctaaagtagtggaatttgctttttaacaagtttgtacagttgtgaaaccatcaatgctgtccagttttagaacactgtcatcacccccaaaagttgtctcctgcctctttgcagtcagtctgctcacctgcctccagctaacaattgatctgc

SEQ ID NO: 205456 - DNA, 601 bp, Human
gagggagagagagagggagagggagagggagagggagagagagaatgagaatgagaatgagaatggatataatttgggttggccttaggaaggagggctctcagaattccacactggagctttgtgtaaaggaagtttatcttctatgacaccagggaggcaacatggaagacatgattttgggagatgtttcaataataagaattgtcacgtgtaaagcatggttgtgtttgcaaagtgtcttatcttcctactagaccttaaacatcttgagggttggagcctttctgatgtgcctctrtatttcccagagccttactaatttcagcatactataaatacaacaaatacctataaaatgagtatgttggtggatgactcatgaacaggttgtttccttcctgtgtccctgggagagcatgtctgtgcttctaccacagctcatgcatggcttgtgtttataatgatttgtttgcatgtctctctgtctgtcctgagctccatgatggcaggggctccatatcccttggctcatgcctggcaagtagtggttgttcagagagtgctggagagaattgttcgagtgaatggatgtgtctaa

SEQ ID NO: 205457 - DNA, 601 bp, Human
gctcatgcatggcttgtgtttataatgatttgtttgcatgtctctctgtctgtcctgagctccatgatggcaggggctccatatcccttggctcatgcctggcaagtagtggttgttcagagagtgctggagagaattgttcgagtgaatggatgtgtctaacactgaaggaaagcagggaaaggagaccagatctgtgctctttggagtttcagattgtagctctaaggatctaaatttccagagggagagaaagtagggaaatggtccataactcatttgtcttccattttctgtcccrtgggctaggtaggtctgttcttgatatggttgggagagtggttgcctgtctcagtgttcaatgtcagatgacaatattagctcacattgtaaatattctgagagtgccataccctcaaggtttcttgttaggttatttcattagggagtgttttctaagattggcttaaagtaaaggattttaaactttttctaagagagacattttaaatttattttaattttcatgggttctccaaatgcagtagactttttggcaaaatctcaggtaaacctcatacatataaatcacagaaatgga

SEQ ID NO: 205458 - DNA, 601 bp, Human
gcctgtctcagtgttcaatgtcagatgacaatattagctcacattgtaaatattctgagagtgccataccctcaaggtttcttgttaggttatttcattagggagtgttttctaagattggcttaaagtaaaggattttaaactttttctaagagagacattttaaatttattttaattttcatgggttctccaaatgcagtagactttttggcaaaatctcaggtaaacctcatacatataaatcacagaaatggaagaattaggtaggtgcaaaagtaattgcggtttttgccattacytttaatggcaaatacttcagttaatgcaggggtgatctaggacctcacctgcttatcatttctttgtcctttgtcaaagccctgaagcatctgggggactttagggctccttggaaggaagtttgaaaaaccccaggtatagaggtagtctgttcattttgacttcctgtttcttctgccactctcaagagacttctgttaagtctgtagaaagacttccccatgctaccatctgtaaccaccaactacgggaaccctagttcactgttggtgggaatgtattttggtatagccattatg

SEQ ID NO: 205459 - DNA, 601 bp, Human
ttttgtatttccctttttgtgttcattttcacctcctctttgagcttgaatcaaaaggttttgaggccaccagtaaatcaggtaaacagtaaaaactggagggaaaatgcctcatatttgtgaatttgccattgcacattcccatggtcagtgtctgatgtggatatagaaagcagcatcttgtccaaggacatggctaggaggggaaaccacagcgggtagacgagaggtaggtgtttgtcttaggtcattttgtgttgctataaaggaatacttgaggctggataatttatacagaaargaggtctttttccttcacagttctgcaggctgtataagaaatatggcattagcatctgctggcctccggtgaggacctttgtgctgcatcaaaacttggtgcagaaggtcaaaggagaagcgagcacctgcgaagaaggaccaaacccaaggggcgtcctggctttataacaacccactctcagggaacgaatctattcctttagaaacagtcccgtttcatgagagtgagagctcacttgatcccttgagaatggcaccaatccgttcatgtgggatatgcccccaggagccgaacacc

SEQ ID NO: 205460 - DNA, 601 bp, Human
attaaaccgtgaaaatgtttggttcactccaaaaggaaaccccatagtcattggcagtcacttccaattcttccctctgcccaggtcccagcaaccaataagctatgttctgtgtctgtggatttgcttcttctgaacctttcatatatatagaatcatacaatatgcggacttctgtgtctggctttttcatttagcatacttttttcaaaggcccatccatgccattgcatgcgtcagtgcttccttcctttgtattgctgagtaatattccaatgtgtagcccaacaacattgtatcmgttcatcagctgctgaacatggggattgtttgcattttggattattatgaacaatgattctgtgggcatttatgtgtgcatttttgtcaaatccttttctgtgtagagatgatcgtgtgggttctgaacatggttctattaatatggtattttacattgattgagttttatatgttggactggtcttcttttcctaggataaatcccacttggtcatggcttataatcctttttatattttgctgtgttcagtctgctagtattttgctcagaattttttcatctatattcgtaacgata

SEQ ID NO: 205461 - DNA, 601 bp, Human
gtttggagtatgtaatcattgatttcttaatccttcgacaataaaaacctgtctatagctttccattattgcgcgccttaaatgattaattgtttcacatgttttttataaaattatagtgacacatcagcaatcctgaaaatggcatttaatatataaatatgattgaaaaatatatgaaatctaacagaggtgtttgaacagttaagcttaagtatgttcttcaactttttaattaatcaacattttgattttctgtaaaatgaaatcacttaacatttatgtgtgttgccaaaatgasaacctttgtttaataagctcctttatacactacgtcgctgatactcctaaaatggacgccaagacatgaaagacatgctgataggcactcggaaggaaatgtttgcctgactgcagtcttcctttttgaattgattacaggatcattcatgcttatactaaaaaacaacaatatatgaaacaaaaagaaagttcagcaaacaagtttaaattgagcttcattttaatactgaccgtcttattgccgatttatatttacttccatttacttcttaaacatttaacataacttcttgccatt

SEQ ID NO: 205462 - DNA, 601 bp, Human
ggtaacggggatggaagagggaatagatttaaaataaaatttaaacgcctagatagaaaaaggcagtactataatgagattaatttcaacaaagtatgttcacttttcttgcacaatacacatattgtagagtgtgattataaaaaatcaggagattagttgtattacacgtagctgtaagaatcttgttttatgactattttggttgttacattttattggccagaaaacttgagttgttcaagtcttctgacagacatgtaaaataagcaattcaaatcagggaggaagaaactgagawtgagccactgctcacatgctagatcttacatatgtcaaagcaggtgtaattgaaccttcgaagacgtggctgcaacgtaaacaacagtggcctgtttatgtgggatttttttctttcctttgttttctgttgtgagacaaaggaggaagataaggcccctcccacatcctgaggccagcatggccctttgaaagaaggtttgctagggggtgtggtatattttaaatggacctatcagttcactttctatattctagtggttcgtgtgtgtgtatgtttgtgagtgagagagagagagag

SEQ ID NO: 205463 - DNA, 601 bp, Human
attggccagaaaacttgagttgttcaagtcttctgacagacatgtaaaataagcaattcaaatcagggaggaagaaactgagaatgagccactgctcacatgctagatcttacatatgtcaaagcaggtgtaattgaaccttcgaagacgtggctgcaacgtaaacaacagtggcctgtttatgtgggatttttttctttcctttgttttctgttgtgagacaaaggaggaagataaggcccctcccacatcctgaggccagcatggccctttgaaagaaggtttgctagggggtgtggtrtattttaaatggacctatcagttcactttctatattctagtggttcgtgtgtgtgtatgtttgtgagtgagagagagagagagtgcatttaactcagtggcctaagtttattccatgcagttgttctctgatacaaaaagaaggcataggttcatctttgaagaggagataaaagtcacgtgatctgaggagatgtacttgtaggctgctttggtggcccaggcgtgaggcagagctggtggcccatggaatggagatgaggagtgtctcagccgtgggtatacactgctgaggtcattc

SEQ ID NO: 205464 - DNA, 601 bp, Human
ttaaatggacctatcagttcactttctatattctagtggttcgtgtgtgtgtatgtttgtgagtgagagagagagagagtgcatttaactcagtggcctaagtttattccatgcagttgttctctgatacaaaaagaaggcataggttcatctttgaagaggagataaaagtcacgtgatctgaggagatgtacttgtaggctgctttggtggcccaggcgtgaggcagagctggtggcccatggaatggagatgaggagtgtctcagccgtgggtatacactgctgaggtcattcagcasatactcccagaggacttgctctgtgccaggcaaaagatataattgctgcccataggaattcctagtgtagttgggtagaggagaggataggaataattgatgaatgtaggtaccttttcaggttaccaaataccttcgcctgttattccatgtaatccaagcagccatgctgggcgcagggactggtacacaatggccacttaataagtattcatggaagaaataaactgagtggcgaaccagagtattagcttgttgagtcttatttgactaagagagtgttttttccttcatggatag

SEQ ID NO: 205465 - DNA, 601 bp, Human
gaccatggagtctagggggctaggggatgtgatcagaagtgttctagagaacatggtgaaacaggggaggatgagtaagtagaaatttagatcaagtgaaagaaaaggttttgagagtactggagttaggagtttattctgaaactcatcagattctgaataattgtaccacctctgcaaagctcgacttaaaagtttggccgtgagttgtgctcaggttattttatttctccaaaagcaagcagaaagtgaaaaatgttacctgtgtgtgttctgtattgcacgttatcagaggagatgmacattttcttctcttacagttaagaatctctcagtcttacacaattagaataccccttatgtgtggatctggaggttttgtgcaaaatactgaagaattagtccctctggagtgatgccattcttttatccttgtctatcaatgtcatttatatctcttttcctattagcccttctaagttattgtacctcatctgaaaagatcaaattgttctcaaagacccaggagtgtttcaccttagctgtattcatgggaaatctgcctttgaaacaaatagtcctttaccgtcttgggttagag

SEQ ID NO: 205466 - DNA, 601 bp, Human
aacagaatcgtggcaaccttgattctgttttctgtctctatgaatttgactacttcaggtacctcatataagtggaatcatacagtgtttgtccttttgtgactggcttctttcacttagcataatgtcctcaggattcatacatgttttagcatgtgtcagaatttccttcttttatgaggctgaataatactctattgtatggacagaccacattttctttctccattcatctgccagtggaaacttgggttgcttctaccttttggctgttgtgaataatggtgctatgaacatgagkgcacagatatctctttgagctcctgtttccagttcttttgagtatatccccaaaagtggaattctgggttgacaatttcttttttttcagcgcaacttcagttgtactcccttcttttgcctttgtgttttctgatgagaaatctgctgtcatttgaattgttttgcccttcagctaagatgtcctttttctctcactactttcaaaatcttgctgtgtccttagttttcaaggaatgtgttatgttgtgcctttttgtggatttctttgggtgtatcctgtttggggctcattcacctt

SEQ ID NO: 205467 - DNA, 601 bp, Human
tcaccttcttgaatatgtaggtttatgtcttttgctaaattgggaaagttgtcaggcattatttctttgaatacttccccaggtgtgccctctttctcctttccttccaagacttggaggatgtgaatattaaaactttgttatagttctaccagtgcttgatactgattattttttaagtctattttctctttactattcagattgcataatttctattgttcttaccttcagattcacctattcttttctctgtcatcttcattctgctgtttagctcactgggtgagttttaatttcrgttattttatctgctatgtctttactgagactttctgtttttaaaatttgtttcatgcccatttttagttgtttgtggaaacatgtttataatggctactttcaaatccttgtcagataattccaacatctgtgccatctcaatgttggcatctcttgactgtgttttctcgtttaaattgaggttttcctggttcttggtatgataaatgattttgattatatccaggcatgttgggtactatgctatgagactggattttatttaagccttctgtgttaacaaaccttctctgacact

SEQ ID NO: 205468 - DNA, 601 bp, Human
tttttaagtctattttctctttactattcagattgcataatttctattgttcttaccttcagattcacctattcttttctctgtcatcttcattctgctgtttagctcactgggtgagttttaatttcggttattttatctgctatgtctttactgagactttctgtttttaaaatttgtttcatgcccatttttagttgtttgtggaaacatgtttataatggctactttcaaatccttgtcagataattccaacatctgtgccatctcaatgttggcatctcttgactgtgttttctcrtttaaattgaggttttcctggttcttggtatgataaatgattttgattatatccaggcatgttgggtactatgctatgagactggattttatttaagccttctgtgttaacaaaccttctctgacactgtgctagcaggggaaaggggggcactccctcatttctgtgaggtgggggagtaggagggtaccttattattggtaggtgagggtgaaattcaggctacccatagttgatactgttatttttattgttagttttgtactgggtgcagtaacctggacagtgtctcagctctgt

SEQ ID NO: 205469 - DNA, 601 bp, Human
ttactaactggataatcttgggaaaatctccaaaactctaaaggttgacttttcctataagtgaagtggctgtcataataccaatatcaaagggttgttcagaatattaagtgagataatgtgcctgaaagcaatttagctgataggtatcataaacatgggagacaattatctagttagtttctccagacacatgaggatgatggataaagataatgtacctaattctgtatgcttttcagctgtttattccaatagactgttttatatatatatatatttaaaatgctttaaaattgtktaaatatcgaagaccttcaaatagatagcaaagtattaaataaagtagaatgaatacccatatacccattattcagaagtgacaaatgccatatttattttcctcagatgttaaaaaaaaaaattaaggatataactaaagccttactctctctcacgtctgaaattggtgtagaacactttcatgcacatttttctggaattacagcgtatacatgtagccataaacaatatattttacatgtttaaaaactttgataaaatattttaaactgttgctatccttttgcaaatgaaatta

SEQ ID NO: 205470 - DNA, 601 bp, Human
gcatgtccaaccccccttcacatcatagcctgaactgggttttcaggttgactttggaatgcccttggccaagaggagaggtccattcagatggttgagaggggcttagaattttatttttggtttccagtacccatttatattcctgtgctagagtatcaatgttcttgtctcactgtatcttcaccaacagttggtagtaccagactttaaaattcttgtcaatctcatgggcaaggaatattttgctgttacgtttattggtatagctgattacttagtgagattgaacatcttttawtattggtaatttagatttccttttctgtgcattctgtattcatatgctttgcacagtattcttttgagttgttttattcttgctaatttgtatcatattaactaatcctttgttatgctcatcgaagataccttctcaatctttttttttctcattttccttatggcaactttggaaattaactatggaatatgtttgaaaaattggaatgttttcatttttcattttcagaagtgattttagtaataatacatgcttacaatccatgctttccgatgaggcagagagggctaatgggac

SEQ ID NO: 205471 - DNA, 601 bp, Human
ttcctgtgctagagtatcaatgttcttgtctcactgtatcttcaccaacagttggtagtaccagactttaaaattcttgtcaatctcatgggcaaggaatattttgctgttacgtttattggtatagctgattacttagtgagattgaacatcttttaatattggtaatttagatttccttttctgtgcattctgtattcatatgctttgcacagtattcttttgagttgttttattcttgctaatttgtatcatattaactaatcctttgttatgctcatcgaagataccttctcaatctttttttttctcattttccttatggcaactttggaaattaactatggaatatgtttgaaaaattggaatgttttcatttttcattttcagaagtgattttagtaataatacatgcttacaatccatgctttccgatgaggcagagagggctaatgggactaatttcttagaatgcatcagaattttatctccttaattaacatctagaggaaaaagtttctcattttccatgtaaacttttggtcaacttgaaatgtcaggcagattcttagtccccaggcatccatcattgaattaaaga

SEQ ID NO: 205472 - DNA, 601 bp, Human
tctaaacaaaacccacctaatcttccaaatcactttgcaaaacaaaagaacacacagaagatatagaaaccaggaggaccaggcggctgtggagtattttaggcagcactccctctttccctgctagtaaccatgtatatgaaattgctttagtaattatacatctgttttaaaattggaatcggaaaggatactctttccacaatcctataggaaccctccttggttgttcaaacatttggcaccactgcgtgtctgctgatggtttgccacagtcataggtgaggttctgggcagataytaacagctgagggaagagtgggcttgcaaacccaaacgtggaagtcagaccttgaggtatggttctcacagacttgactttcttaaggacagtggccatacgctttgctcagtcaattccagttggccttattgtactcgtttgccatttactgcagggagtgagcctcccttcagcatataggaaccagtgaaatgtcctctcattggctagctttgatatttccttctttctccacttactgaattcttacctggaatcagcatttggctccagtcaccgtctctgcaccattcctct

SEQ ID NO: 205473 - DNA, 601 bp, Human
taaccgctgccatcacccagctgatgatacagtggtgaaggactacagatcagtaaatgtggccaagcgcagtgactgttaggagaggagaaaggatcctgcttttcctcaccttcttgtccctctgcaactcagagggagaatcaaaattcacattttttagagaacatggatctttcagaatatgagagtttcatgagtgtttttttttttaatttaacacttaagtatagcactctgaaaaataaacactctagagttttagtgtcttagaggtcatttagtttgcctccttgtaacsaaaccgatgaaaatctccttttctgacctcctgagaaatagatgctagaatctctgggcagcagtccttgtggtactcgtactcagtgcctagcaaagaggtccataatgagatattctgtgcgtctctgactcagaacattcctgtttcatcttccacctggattccttctaatgcttttcaataacagatcagtgtagttgagttttgtttagctatttctgtatgtaagcatttttaaaaaaggaaaaagaagcaaaagaaaaccacaaaaacccaacatgctgtttaaataaagaa

SEQ ID NO: 205474 - DNA, 601 bp, Human
cagatcagtaaatgtggccaagcgcagtgactgttaggagaggagaaaggatcctgcttttcctcaccttcttgtccctctgcaactcagagggagaatcaaaattcacattttttagagaacatggatctttcagaatatgagagtttcatgagtgtttttttttttaatttaacacttaagtatagcactctgaaaaataaacactctagagttttagtgtcttagaggtcatttagtttgcctccttgtaaccaaaccgatgaaaatctccttttctgacctcctgagaaatagatgstagaatctctgggcagcagtccttgtggtactcgtactcagtgcctagcaaagaggtccataatgagatattctgtgcgtctctgactcagaacattcctgtttcatcttccacctggattccttctaatgcttttcaataacagatcagtgtagttgagttttgtttagctatttctgtatgtaagcatttttaaaaaaggaaaaagaagcaaaagaaaaccacaaaaacccaacatgctgtttaaataaagaaaaatgagttttacttccaagagagctttcgtcattttcttaatgc

SEQ ID NO: 205475 - DNA, 601 bp, Human
tattgctaagtgattctactttttaaagacctccagagagagcatccctaatctcctttagtttgcctttacagtgtttaatgacctttgctgtcaggaaattcttcctcatatttaacccagctgtcccttcccaccaatcactcccatttcttttgttgtccttggtggtgacagaatataggggtcgttgtcttcttgataatatacttaatgttcctgaagggtatgagggaggcctcccttagcccagacttctgcaagtgagagaaatataaattttttctcctttacacccccrttctcagtggttctatttggacatataatctctgacgtttgttcttaagtctctgttgcaaacattcacatcaggccttcctggagatacccattggttccattttcactcacagggcaagatcctttcatgatttccctggctgttgattcattcacattaactcctgtttgttgagccctcattaggtgggaggtaccaccctagtggctgatgggatgtgaagaggagtgactcccactgacttgcacctagaaggaggagcctgaatgtcacctgccagttacagtccttgcgata

SEQ ID NO: 205476 - DNA, 601 bp, Human
ttttagcattggaatttaagtgttttgaaactatatcacactgtttttgaagaaactttatttctgatagtagtttagtttatatgatgaagcattttaatgaggagatgaagtcattcatttcatgatggttgtttgatgtctttttttcacagtttgttgaactgttcaggacagtgatcaagtgataccacgcagtggtccaaaaccagtctgaatatggccttaggctctgggttttaacaccgctagtctgtgaaagatcagttgccacagtttttggtttccacatatgtaaagwttcgtcataattagcaagttcacccttagtaggctgtatcacctcttgttccccacatcccagatttcagtccgtccttggctctcggatgggaggccactctgattgcagccacagttcatgccccacacagacattcactgagcctctgcccagcgttctgacacagacttccacaaggcccacatctggattctttgtccacgctaacaccatcacatttaattaattaatatctttgtgaagctgggtttgaaacaagaaaggtttggactgtttcagtggatgttttgttcatat

SEQ ID NO: 205477 - DNA, 601 bp, Human
gctgcgatctttctatccattactttcatctgtggcttctcctttaaccttttggggtcatacagcacaaaatctaatttcgacacgtggcagcctttcacatatttcaaaaatgacccttctgtattccaccaatcagacaggacatggttcagttacatggtttttctcctaaccatctccagtctagcaatttctttattgtggagtgggatgcaaaaaggaaagtcacatttttatgtaggttctgtctgacaagtgtggaaccattactgacctagttggaggtcaaggaagtgtsagaacttcctgtgtgcttgatttgaccaagtgtagcatcttagtctcccagtaggacaaaagggtttccgtgttatccagggacggggtggatcaactttgatcatttggacctggctttggtcatttcttggtacccattacatggctgggtgatggcagtccatgaatgtgtggagaatgatgtcaaacagggtgctggatgacaagttcgggtctccagagcacttatgtggtctgtgaacataaatcattccattcagtcaaacctccacccttgccccctccctcattgagatgc

SEQ ID NO: 205478 - DNA, 601 bp, Human
tttttctcctaaccatctccagtctagcaatttctttattgtggagtgggatgcaaaaaggaaagtcacatttttatgtaggttctgtctgacaagtgtggaaccattactgacctagttggaggtcaaggaagtgtcagaacttcctgtgtgcttgatttgaccaagtgtagcatcttagtctcccagtaggacaaaagggtttccgtgttatccagggacggggtggatcaactttgatcatttggacctggctttggtcatttcttggtacccattacatggctgggtgatggcagtmcatgaatgtgtggagaatgatgtcaaacagggtgctggatgacaagttcgggtctccagagcacttatgtggtctgtgaacataaatcattccattcagtcaaacctccacccttgccccctccctcattgagatgctacaccactgcgtcttctctctcttggggccacttattcttgtcttgtttgtgaaagccaaaacaataggatgctaggttcttgaggcagataaaatagattcccaggttaactccatttatgatttgtcgatcttttcccttcttcactcctgcagtaaggg

SEQ ID NO: 205479 - DNA, 601 bp, Human
aaccatctccagtctagcaatttctttattgtggagtgggatgcaaaaaggaaagtcacatttttatgtaggttctgtctgacaagtgtggaaccattactgacctagttggaggtcaaggaagtgtcagaacttcctgtgtgcttgatttgaccaagtgtagcatcttagtctcccagtaggacaaaagggtttccgtgttatccagggacggggtggatcaactttgatcatttggacctggctttggtcatttcttggtacccattacatggctgggtgatggcagtccatgaatgtrtggagaatgatgtcaaacagggtgctggatgacaagttcgggtctccagagcacttatgtggtctgtgaacataaatcattccattcagtcaaacctccacccttgccccctccctcattgagatgctacaccactgcgtcttctctctcttggggccacttattcttgtcttgtttgtgaaagccaaaacaataggatgctaggttcttgaggcagataaaatagattcccaggttaactccatttatgatttgtcgatcttttcccttcttcactcctgcagtaagggaattatcata

SEQ ID NO: 205480 - DNA, 601 bp, Human
aattatcatagggagggaccatcagacaggcctttttggggactttttcttatatagcgttaacacatttatttccaagtggtttaaaggcaaaatatatgaatgcctaggtattttgagatctttcagaaaatagaaggaatgggaatgttcttgttcatgttattgggctagtattgcatgagaagagcagtcaaaagcctaaaggaaatattagcagattgaatatcagtttttagagagaacttcttttggttcacctgggtagctggtagcatgctatgtgctgtgagatggtcayacacgctgtctcatgtaggtctcacacaactgccctgtgaggcttacattctgtcattaacggaggaggatggtgacactcaagtggggaccagctggtccttgcagcagctgaggtcataggcgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacac

SEQ ID NO: 205481 - DNA, 601 bp, Human
tttcagaaaatagaaggaatgggaatgttcttgttcatgttattgggctagtattgcatgagaagagcagtcaaaagcctaaaggaaatattagcagattgaatatcagtttttagagagaacttcttttggttcacctgggtagctggtagcatgctatgtgctgtgagatggtcacacacgctgtctcatgtaggtctcacacaactgccctgtgaggcttacattctgtcattaacggaggaggatggtgacactcaagtggggaccagctggtccttgcagcagctgaggtcatagscgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacacccaagtcccagcttttatccacagtcctgcgctgtctccttattttaaaagagcaactcaccacaatcacgtagggtttattccagaaacaaaagaatagttcttaggaaagctagtagtgta

SEQ ID NO: 205482 - DNA, 601 bp, Human
tgctatgtgctgtgagatggtcacacacgctgtctcatgtaggtctcacacaactgccctgtgaggcttacattctgtcattaacggaggaggatggtgacactcaagtggggaccagctggtccttgcagcagctgaggtcataggcgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacacccaagtcccagcttttatccacagtcctgcgctgtctccttattttaaaagagcaactcaccacaatcacgtagggtttattccagaaacaaaagaatagttcttaggaaagctagtagtgtaatacagtctattaattcattagaaaagagactgaccatcttgatagatatgcaaaagccatttggtttgattcaacacctactttttcttaaaaataaagaaataaaagctgttggtaaatgagatatagaaggctacctctctcacataatag

SEQ ID NO: 205483 - DNA, 601 bp, Human
ggaggatggtgacactcaagtggggaccagctggtccttgcagcagctgaggtcataggcgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacacccaagtcccagcttttatccacagtcctgcgctgtctccttattttaaaagagcaactcaccacmatcacgtagggtttattccagaaacaaaagaatagttcttaggaaagctagtagtgtaatacagtctattaattcattagaaaagagactgaccatcttgatagatatgcaaaagccatttggtttgattcaacacctactttttcttaaaaataaagaaataaaagctgttggtaaatgagatatagaaggctacctctctcacataatagagaatttctaggaaaagctgttaacattcttactaaagtcacggccagttaaaaatgcctgccacagtcacagttcttcaaccttgtt

SEQ ID NO: 205484 - DNA, 601 bp, Human
tttagcactcactcctcattctcctcttccccctgtccttggcaattactagttcactttttgtctatggatttgtctattctggacctttcacgtaaatagaatcatgtaataggtggtgctggtcattagcatctggcttcttttgcttagcatggtgttcatggttcatctatgttgcagcatgtatcagtattccattccttttatggctgaataataatccattttattgacataccatattttgacattttatttatccatcatcagttggtggacatttgggttctttttactrttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccagtaatgtatgagcattccagtttctctacatccttgccaacacttgttattattattttttaaatgacagccatgctaacgggtgtgaagtggta

SEQ ID NO: 205485 - DNA, 601 bp, Human
ttatggctgaataataatccattttattgacataccatattttgacattttatttatccatcatcagttggtggacatttgggttctttttactgttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccartaatgtatgagcattccagtttctctacatccttgccaacacttgttattattattttttaaatgacagccatgctaacgggtgtgaagtggtatctcattccaagtgtgtgcatattgaagatgcacttagattgatccacagttgggattttgctagaaggctctatggaaaaagagaggtcttacgtagctgaggatggtggcaagtggataattgaagtgacgggtcagggattgaattaaagaaatttgcaggaccaaggaaagcaaaccacaaaaatttactaaagggaagaaa

SEQ ID NO: 205486 - DNA, 601 bp, Human
ggctgaataataatccattttattgacataccatattttgacattttatttatccatcatcagttggtggacatttgggttctttttactgttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccagtaawgtatgagcattccagtttctctacatccttgccaacacttgttattattattttttaaatgacagccatgctaacgggtgtgaagtggtatctcattccaagtgtgtgcatattgaagatgcacttagattgatccacagttgggattttgctagaaggctctatggaaaaagagaggtcttacgtagctgaggatggtggcaagtggataattgaagtgacgggtcagggattgaattaaagaaatttgcaggaccaaggaaagcaaaccacaaaaatttactaaagggaagaaaggaa

SEQ ID NO: 205487 - DNA, 601 bp, Human
tgggttctttttactgttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccagtaatgtatgagcattccagtttctctacatccttgccaacacttgttattattattttttaaatgacagccatgctaaygggtgtgaagtggtatctcattccaagtgtgtgcatattgaagatgcacttagattgatccacagttgggattttgctagaaggctctatggaaaaagagaggtcttacgtagctgaggatggtggcaagtggataattgaagtgacgggtcagggattgaattaaagaaatttgcaggaccaaggaaagcaaaccacaaaaatttactaaagggaagaaaggaagccttaaattaatgaaagactcaatattgtaaagatgtcaattctcttaaaatctcatatgtaaatgtaatataa

SEQ ID NO: 205488 - DNA, 601 bp, Human
ctccagaactacgagaaaatcaatttctgtgtctaagacccagatttgtggtaatttgttgccacacggccctagggaacaatgcagtgactctcagacaggatttgatggagagagtggtcagaaccagtggcgctttctaaaagattgatgccatgagctgtgtttgtctagtctgggcagacaagagatttccattcatgattaaggagggcccacggatctgcgtgatgaatttgaggaggatacactggtcccgcagggcaaggacgtcatcttagtcactgctgtatccccagcrttaagaagagttagaagaggacacagtccacactcaatgactgtttaatgaattaattaataaatagaaaacacacaaaaatgtaaacactatccatttttaaaacaagatactaatttttgaataaaaccaggttgtggtggggaccatagggccagaatagttgccgtccccttcacctcccacttgattcacgcatggtggctcgaggggacagagatgtgagatcgtggctggaaccactgctctgagttggagctgctgaaatggtagcttggcggtctgccctcatggtgcatg

SEQ ID NO: 205489 - DNA, 601 bp, Human
taatttttgaataaaaccaggttgtggtggggaccatagggccagaatagttgccgtccccttcacctcccacttgattcacgcatggtggctcgaggggacagagatgtgagatcgtggctggaaccactgctctgagttggagctgctgaaatggtagcttggcggtctgccctcatggtgcatggcttgaagctacatgtcaaaggaaagcaccatccttgcaaccaatgacactaaaactcaagttagattatggcaagcttgtccaacccgtgggccacatgtggcccaggatgcygttgagtgcatcctaacccatattcataaacttttttaaaacattgattttttttaaattttaagctcattagctatcgttagtgtattttatatgtggcccaaggcagttcttcttccaatatggcgcagagaagcccaaagattggacaccccctggactatagtattaatgcatcacatagttcattcttttcacatagtgagtaaaaagtaattcgtttgataagcaattcttgagcacctcctgtatgctgaacgccatgctacgctctgcggtacagagaacaaagaggtggtc

SEQ ID NO: 205490 - DNA, 601 bp, Human
cactgggcattgtagattttacatatgatggagttttgagattacaggctcatgcctgtaatctcagcactttgggaggctgaggcaggcggatcacctgaggttgggagtgtgagaccagcctgaccaacatgaagaagccccgtctctactaaaaatacaaaagtagtcgggcgtggtggcagatgcctgtaatcccagctacttgggaggcgaggcaggagaatcgcttgaacctgggaagtggaggttgcggtgagccaagattgcgccattgcactctagcctgggcaacaagagygaaactccaagatggagttttatttgggccatattgaggcagaggctcaaatgtaggtgaaatggttggttaactgtatggaataatgtgaagggagctgaaaatccatctgcccagagcaactatgcaggagcatgcctgaaatggcagctcatatttcttggcctcatgctttctaggagtcctctcctaaaacagagacgcctctgtcagattcctagagttcttctaagtaggcatgcctactttgttgagttcctaggtttgatttttgagggaagagaagtcacaaaggatgga

SEQ ID NO: 205491 - DNA, 601 bp, Human
aatggttggttaactgtatggaataatgtgaagggagctgaaaatccatctgcccagagcaactatgcaggagcatgcctgaaatggcagctcatatttcttggcctcatgctttctaggagtcctctcctaaaacagagacgcctctgtcagattcctagagttcttctaagtaggcatgcctactttgttgagttcctaggtttgatttttgagggaagagaagtcacaaaggatggaacatgggatgggggaggagagaggttggagcagagcactgggcatttagggaaaagaatcrtgaagggaaaattcctagaaggggcaacaaacacagcctcaaaaatccacagctcttccctagactgggtctgccaggtgccctgatccagctctctggtcagccgcattctgcatagaaaggggagcagggctggtcttgtccccatggaagtgtgaacttggggctcgtcttttgggagcagagaaaaatagttccttgatatacatgtaagtttctatgtggggtattagaatgaatcctagctgttgggagcatgtcttttacaaatcaaattaagtatcttttatatatagatat

SEQ ID NO: 205492 - DNA, 601 bp, Human
gagctgaaaatccatctgcccagagcaactatgcaggagcatgcctgaaatggcagctcatatttcttggcctcatgctttctaggagtcctctcctaaaacagagacgcctctgtcagattcctagagttcttctaagtaggcatgcctactttgttgagttcctaggtttgatttttgagggaagagaagtcacaaaggatggaacatgggatgggggaggagagaggttggagcagagcactgggcatttagggaaaagaatcgtgaagggaaaattcctagaaggggcaacaaacayagcctcaaaaatccacagctcttccctagactgggtctgccaggtgccctgatccagctctctggtcagccgcattctgcatagaaaggggagcagggctggtcttgtccccatggaagtgtgaacttggggctcgtcttttgggagcagagaaaaatagttccttgatatacatgtaagtttctatgtggggtattagaatgaatcctagctgttgggagcatgtcttttacaaatcaaattaagtatcttttatatatagatatagatagtctgtaatttgatggtactgatgagagt

SEQ ID NO: 205493 - DNA, 601 bp, Human
taggaaatattgtcagagaaaccctaaatttactctcattttcagtcatgaatgaatccctgattactgtgatgaagaaaaatcctgggtcccaacttccttgcccaaatcaacacaaatgtaacctttcatcttgatcaggagatgctgaaggtagaacataaacaaaaacataagaaaccgttcatcactctgagagaggtttaattttcatcagtcaggaaagatacagacaccaaatcaaaggtgttgataggatttcactgtaaggttttggcgattttcttttccctgggtgttmattctccccttgggctgatggtggttggcagagctggagcattcaccgtggcttttctgattcctctttcccatgttggagtaatgtttttagttcattgcccaaatagccttggcagctataatcagtcactggagtatatccttgattgtaggagagacttgataataatgactctttcattcatttattccacaaacataggctgagtgttagctgcgtgcagtgaaccatgggaagtgctatggggaagcacagctatgtaaatcatggctccaactatgtgcaaaggccccatga

SEQ ID NO: 205494 - DNA, 601 bp, Human
atgaagaaaaatcctgggtcccaacttccttgcccaaatcaacacaaatgtaacctttcatcttgatcaggagatgctgaaggtagaacataaacaaaaacataagaaaccgttcatcactctgagagaggtttaattttcatcagtcaggaaagatacagacaccaaatcaaaggtgttgataggatttcactgtaaggttttggcgattttcttttccctgggtgttaattctccccttgggctgatggtggttggcagagctggagcattcaccgtggcttttctgattcctctttcycatgttggagtaatgtttttagttcattgcccaaatagccttggcagctataatcagtcactggagtatatccttgattgtaggagagacttgataataatgactctttcattcatttattccacaaacataggctgagtgttagctgcgtgcagtgaaccatgggaagtgctatggggaagcacagctatgtaaatcatggctccaactatgtgcaaaggccccatgacataaataagcacagaagatgtgtctgtacctctgtatctgctttataacctccctgaggaaatgctacag

SEQ ID NO: 205495 - DNA, 601 bp, Human
caaatcaacacaaatgtaacctttcatcttgatcaggagatgctgaaggtagaacataaacaaaaacataagaaaccgttcatcactctgagagaggtttaattttcatcagtcaggaaagatacagacaccaaatcaaaggtgttgataggatttcactgtaaggttttggcgattttcttttccctgggtgttaattctccccttgggctgatggtggttggcagagctggagcattcaccgtggcttttctgattcctctttcccatgttggagtaatgtttttagttcattgcccawatagccttggcagctataatcagtcactggagtatatccttgattgtaggagagacttgataataatgactctttcattcatttattccacaaacataggctgagtgttagctgcgtgcagtgaaccatgggaagtgctatggggaagcacagctatgtaaatcatggctccaactatgtgcaaaggccccatgacataaataagcacagaagatgtgtctgtacctctgtatctgctttataacctccctgaggaaatgctacaggcctgatccatctctcccctctttaaagactgtc

SEQ ID NO: 205496 - DNA, 601 bp, Human
ctggtccagcccgggctggtctggtcccctccagatgatctcagcgttcatgaaggcaggttctggagacttaggaggagggacccctcccctgccttccctgggacgtggaatcccctgtgagcaggatggatctagggtatgtcttttagccttctgtatatctgcatagacttttcttctgccttctcatagttcatagcttgtgtctacacaagaactctctaaacatgtgatagcgaattaaagccattaactccattatctgggatattgtttcaggtatattttaatattgctrtataatttgtccataaaatgcttatcttcataatgaaatatgaatgggtctttgtccgacagaagacttttgttgaataagatgatggcagaacgctgtaggatcctgctatttgaatcttcttggagtcacattccttagcatctagaggaggtaacagaggacatgtggacgtgctttctgctggcgattaagtcccaggcttgggagtggcttgtagcaggctgatgattgaagtctggagtgattctagcacagaaaagcaaccagggcgcaaggtatttctgtgtgtatttggtt

SEQ ID NO: 205497 - DNA, 601 bp, Human
aggttctggagacttaggaggagggacccctcccctgccttccctgggacgtggaatcccctgtgagcaggatggatctagggtatgtcttttagccttctgtatatctgcatagacttttcttctgccttctcatagttcatagcttgtgtctacacaagaactctctaaacatgtgatagcgaattaaagccattaactccattatctgggatattgtttcaggtatattttaatattgctgtataatttgtccataaaatgcttatcttcataatgaaatatgaatgggtctttgtcmgacagaagacttttgttgaataagatgatggcagaacgctgtaggatcctgctatttgaatcttcttggagtcacattccttagcatctagaggaggtaacagaggacatgtggacgtgctttctgctggcgattaagtcccaggcttgggagtggcttgtagcaggctgatgattgaagtctggagtgattctagcacagaaaagcaaccagggcgcaaggtatttctgtgtgtatttggttcgctgatcagcacttgggttaccaagatgattaaagcacagccttgccctttgggag

SEQ ID NO: 205498 - DNA, 601 bp, Human
tatcttcataatgaaatatgaatgggtctttgtccgacagaagacttttgttgaataagatgatggcagaacgctgtaggatcctgctatttgaatcttcttggagtcacattccttagcatctagaggaggtaacagaggacatgtggacgtgctttctgctggcgattaagtcccaggcttgggagtggcttgtagcaggctgatgattgaagtctggagtgattctagcacagaaaagcaaccagggcgcaaggtatttctgtgtgtatttggttcgctgatcagcacttgggttacsaagatgattaaagcacagccttgccctttgggagagaaaaccattcaaagaaatgctgtgacaaaagacacaagcattgagtgatcaagtacagcatgtgcatgattattggagagcaccaggttgtcagtgaagacagtcgtaagggaggagagatgaggtggtgggggagacgtcttataatcgagtagagtactgagaacaatgctggggttatctctctggtgtacaaagggactaccttggtcagggtcctggcagaaatgtacctaagagggataattggagaaagctgaagga

SEQ ID NO: 205499 - DNA, 601 bp, Human
attggccaagtccaacagaaaccagagttcaagggagcccattgatacaggtcgtgcaacaggatagagagtggtcccagcagagcacacagagactgtcctgcagaaagactgattaggcaccggcaagagtcgtactcagccatgttgagagccctgctgagcttggaaacaatcactttgtgattgtaccaaataggaaggatatgggattctcattgggtgagcaagagtgctttttctgttatttggaagaggtatcactctaagacctgtaatttgcccatccgtgtctggtttytgacactggcaccctagaacatgtacaaaagggtagtgacaccacgatttaaggaccagctctctgtgtatggctcagtcacttccaaaatactaagctaaaatgttttggattcttatgttttatccagcgttacctcacgtcaattcagttcagttcaattacattcggatatttgctgaacatcaagaatttcttggaactatgctggatgtgctcaggatacccagatgagaaggcatggagttagaatacagtaggggagatgatcatgtaaacaaatcgtataattaaagcgaa

SEQ ID NO: 205500 - DNA, 601 bp, Human
gatagagagtggtcccagcagagcacacagagactgtcctgcagaaagactgattaggcaccggcaagagtcgtactcagccatgttgagagccctgctgagcttggaaacaatcactttgtgattgtaccaaataggaaggatatgggattctcattgggtgagcaagagtgctttttctgttatttggaagaggtatcactctaagacctgtaatttgcccatccgtgtctggtttttgacactggcaccctagaacatgtacaaaagggtagtgacaccacgatttaaggaccagctstctgtgtatggctcagtcacttccaaaatactaagctaaaatgttttggattcttatgttttatccagcgttacctcacgtcaattcagttcagttcaattacattcggatatttgctgaacatcaagaatttcttggaactatgctggatgtgctcaggatacccagatgagaaggcatggagttagaatacagtaggggagatgatcatgtaaacaaatcgtataattaaagcgaagcctggtgaatctaatggaagctcttaactgacctgcccttgcagactcactgtgttaattg

SEQ ID NO: 205501 - DNA, 601 bp, Human
tacagtaggggagatgatcatgtaaacaaatcgtataattaaagcgaagcctggtgaatctaatggaagctcttaactgacctgcccttgcagactcactgtgttaattgggaagccttgttctctctccaaacgctgtggctgctgggctggctagcctacatggtttcggcttatttggctgtgtctctgtgcacctgtacacgtccatgatttgcatgtttaccaagagtctcctgtgtgtgttcccaaatcattttatgtcagttgttagtaattaaatttatacaatttaattacrttttaagtgaaccagtgaaatatagatgcaaaataaaaagctttcgtttgcgttaaaattaagtcaaacatttcagaaaaagttaataaagggtagtcacttaaaaaatgccatttgaaatgggtacagataagacagctcctcatcccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaaga

SEQ ID NO: 205502 - DNA, 601 bp, Human
ggtgaatctaatggaagctcttaactgacctgcccttgcagactcactgtgttaattgggaagccttgttctctctccaaacgctgtggctgctgggctggctagcctacatggtttcggcttatttggctgtgtctctgtgcacctgtacacgtccatgatttgcatgtttaccaagagtctcctgtgtgtgttcccaaatcattttatgtcagttgttagtaattaaatttatacaatttaattacgttttaagtgaaccagtgaaatatagatgcaaaataaaaagctttcgtttgcrttaaaattaagtcaaacatttcagaaaaagttaataaagggtagtcacttaaaaaatgccatttgaaatgggtacagataagacagctcctcatcccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaagacagcttgaaatagataacttggcaggggaacgggaggttgctggctagggcc

SEQ ID NO: 205503 - DNA, 601 bp, Human
ttttaagtgaaccagtgaaatatagatgcaaaataaaaagctttcgtttgcgttaaaattaagtcaaacatttcagaaaaagttaataaagggtagtcacttaaaaaatgccatttgaaatgggtacagataagacagctcctcatcccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaagayagcttgaaatagataacttggcaggggaacgggaggttgctggctagggcctggagaaggacttgtgggcagcactgaccgtgcatccacctgaggctggagattgtgatttttgtcatggcccccacctacctaaacaactgtgcaactttcttttgcagtgcttgacaggctgacgtagaagtgcaaaaatagttgcttagagcgatccaggatggggattttgtgggggcaggtgtggcaggggtttaaggggaaacgagagttgagtttgggcaagaatgatttaaaagtgactta

SEQ ID NO: 205504 - DNA, 601 bp, Human
ccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaagacagcttgaaatagataacttggcaggggaacgggaggttgctggctagggcctggagaaggacttgtgggcagcactgaccgtgcatccacctgaggctggagattgtgatttttgtcatggcccccacctacctaaacaactgtgcractttcttttgcagtgcttgacaggctgacgtagaagtgcaaaaatagttgcttagagcgatccaggatggggattttgtgggggcaggtgtggcaggggtttaaggggaaacgagagttgagtttgggcaagaatgatttaaaagtgacttaagccttttggccagaattgccatttttcattaatttgcctatgtgatgaacatgaagggaaagaagagaggtacctgctatgttttctttctttcttactccctctccctctctcttttttttttgagactggatcttggtctgttt

SEQ ID NO: 205505 - DNA, 601 bp, Human
tgatcttgacaacaataagtttgtcgatggtaggcaaaaaattaagactgtaccttgatggtttctcaatttttctgtgagggaggaatgagcagtgaaatgatgggggtgggagcctgaggaccgtgaagacagcttgaaatagataacttggcaggggaacgggaggttgctggctagggcctggagaaggacttgtgggcagcactgaccgtgcatccacctgaggctggagattgtgatttttgtcatggcccccacctacctaaacaactgtgcaactttcttttgcagtgcttgrcaggctgacgtagaagtgcaaaaatagttgcttagagcgatccaggatggggattttgtgggggcaggtgtggcaggggtttaaggggaaacgagagttgagtttgggcaagaatgatttaaaagtgacttaagccttttggccagaattgccatttttcattaatttgcctatgtgatgaacatgaagggaaagaagagaggtacctgctatgttttctttctttcttactccctctccctctctcttttttttttgagactggatcttggtctgtttgcctaggctggcatgcagcgg

SEQ ID NO: 205506 - DNA, 601 bp, Human
tctgttcatgccctttgtccactctaatggggttttgttttttcttataaatttgtttgagtttcttattagatactagacctttgtcaaatgcatagtttgcaaaaattttctcccattctgtaggttgtctgtttactctgttgatagtttcttttgctgtgcagaagctctttagtttaattagatcccatttgtcaatttttttcttttgttgcaattgcttttggcatcttcattatgaaatctttgcccattcctatgttcagggcagtataggttgtcttccagagtttttatrgttttgaggtttacttttgagttgactttttctatgtggtgtaaggaatcagtccagtttcaatcttctgcatgtggttagccagttatcccggcaccatttatggaatagggagtcctttcctcattgcttgtttttgtcagttttgttgaagatcagattgttgtaggtgtgcaaccttatttctgggctctctattccaatccattggtctatgcttttttttttctttcttcttcttttgagacagggtctcactctgtcacccaggctagagtgcagtggtgcaatcgcagctca

SEQ ID NO: 205507 - DNA, 601 bp, Human
attgcagaggtcgaggggcttctggtgtgggtggggctgcagccttgggtggtgtaagtgaagtgataaagaccactggatcagaagacatctagaaacatagaggcaaaggggtttcaagaccttctttggggacattgagaccaccccaaactgccaagatttgtgatagataagtggacagggagatcattggcaaagccattgataaatatggtgacagctccaagaagattggcaggcgagagagaggctgaggagtgagtgtggtataatggcatgggcctcaaagggcttttcmctaaggagaggggaatggtggttttcccctgtatgatttctttggggcaaaccagacccgtttttctgtaagcacaaaatttgtgcttttgattagcagaatatctgctcccatttgaggaggcatctgtctgctatccgtgtgactcttatggaaaattctaaaagtgactggtgccataattggagctaggactcacttcttgctcctatgattctactttgatattaaataagtttcctttatgagacaccagtcagtaaatagaacaggatgtatggttaaatagctaaaattatt

SEQ ID NO: 205508 - DNA, 601 bp, Human
gggtggtgtaagtgaagtgataaagaccactggatcagaagacatctagaaacatagaggcaaaggggtttcaagaccttctttggggacattgagaccaccccaaactgccaagatttgtgatagataagtggacagggagatcattggcaaagccattgataaatatggtgacagctccaagaagattggcaggcgagagagaggctgaggagtgagtgtggtataatggcatgggcctcaaagggcttttccctaaggagaggggaatggtggttttcccctgtatgatttctttggkgcaaaccagacccgtttttctgtaagcacaaaatttgtgcttttgattagcagaatatctgctcccatttgaggaggcatctgtctgctatccgtgtgactcttatggaaaattctaaaagtgactggtgccataattggagctaggactcacttcttgctcctatgattctactttgatattaaataagtttcctttatgagacaccagtcagtaaatagaacaggatgtatggttaaatagctaaaattattttcatcattgcaattatagtatgccttgccatttcaaaccaaatat

SEQ ID NO: 205509 - DNA, 601 bp, Human
aagtgactggtgccataattggagctaggactcacttcttgctcctatgattctactttgatattaaataagtttcctttatgagacaccagtcagtaaatagaacaggatgtatggttaaatagctaaaattattttcatcattgcaattatagtatgccttgccatttcaaaccaaatatccacttatctttcctgaaattttgcaagaaatctattattcgaggatgcagagatgatttttttttggttgagttaaacatttttatggattagatatgaattcagtaaaaataattgtattgggtaatatgaataattcatgacatgtaatttcacatcagttctaccttaaaaataaagctattggtttatgtactgggaagatgtattttattatttagaaaggtagagaacattattttggaatataactcactgtatgattaactagatacattaaatagtaagattgaaagaaagtacagaattcaaactaaggtgctttgatgcaattcacctgttccatcttcttgatgaaacactagttgctctgtgtctgtcattagcgattccgcaaggcatgtggtgataagacttc

SEQ ID NO: 205510 - DNA, 601 bp, Human
tgcttgaacattgtaatgggtgtgacggctgccaggtgcctcatttggggagtaggggacaactttctggctaggtcattctttccaaagacatgtactctctgcttcctctgtgtgtagcccagcatactgggacatccatatgactaaggcttggggagtttcttgcagagtggtgtggtggcacagatcaaaatcttggtagaaaagtgagcccaggtagtcacaggcttgacccaagcctggaaggaggagcaggagttagctatggagaagaagaggggagagaagggggacactsaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccatagtcagccgaaagtctctcgtgaaagttttccctcttaaatgtttgtggtggtagttcaaaatggaattggtcc

SEQ ID NO: 205511 - DNA, 601 bp, Human
gtgtggtggcacagatcaaaatcttggtagaaaagtgagcccaggtagtcacaggcttgacccaagcctggaaggaggagcaggagttagctatggagaagaagaggggagagaagggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatarcgggaaccactgagcagcgctgatgacagagatgttctgtgttggtaccatagtcagccgaaagtctctcgtgaaagttttccctcttaaatgtttgtggtggtagttcaaaatggaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccact

SEQ ID NO: 205512 - DNA, 601 bp, Human
caggcttgacccaagcctggaaggaggagcaggagttagctatggagaagaagaggggagagaagggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccayagtcagccgaaagtctctcgtgaaagttttccctcttaaatgtttgtggtggtagttcaaaatggaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaa

SEQ ID NO: 205513 - DNA, 601 bp, Human
agaagaagaggggagagaagggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccatagtcagccgaaagtctctcgtgaaagttttccctcttaaatgttkgtggtggtagttcaaaatggaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaaaggcaccgaatgtcagagtctcctacagaactcagccaactttta

SEQ ID NO: 205514 - DNA, 601 bp, Human
gggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccatagtcagccgaaagtctctcgtgaaagttttccctcttaaatgtttgtggtggtagttcaaaatkgaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaaaggcaccgaatgtcagagtctcctacagaactcagccaacttttagggcaaggctctgtacttc

SEQ ID NO: 205515 - DNA, 601 bp, Human
ctgtgcggcctggttcccaacaggccacagcctggtccactagctaggggttggggacccctgctctagagttaactacagatgacattctggcgaacatactaccagacatttctctagaattcataactttgtattcttagtccttcttgcaaactctggtgtgcttggtcctctctgtaggatatctgttgagattgcctagaatttttttttctttactcttcaagtttcttaatttttgccaagtgttccattattggaacgctaagcatgtgggagttatttgtatcctactcarggtcatcgccaaggtctgtttgcaaaaattcaaaaaattgcaacctcaggcataaatgggtacggactatgttcaattttgtttcttctttttacagtgtgtggcttgttttgtaaacaaatgaatacatgaattaaatctatatggagtacaaagggatgaaggagaaacagcttctgagctgtttgtaaccatccttgtttgcataacctacttattattgaattcagttcagagatcatgctggtggtcatcttactggttagctttgcctcactggactagagtcactcagatgaa

SEQ ID NO: 205516 - DNA, 601 bp, Human
ccaggtgcgatggctcacacctgtaatcccagcactttgggaggccgaggcaggtggatcacccgagatcaggagttcgagaccagcctggccaacatgatgaaaccccatctctactaaaaattcaaaacattagccaggcgtggtggtggaggcctgtaatcctagctgctcaggaggctgaagcaggagaatcacttgaacctgggaggcggaggttgccgtgagccgagattgcaccattgcactccagcctgggcgacaaaagcaaaactcttgtctcaaaaaaaaaaaaaattckgtctaaattccagtgatgatcagatgtgaacataaacacgttcaggatcatatacattgctggatttgccatatctgactttgtctgtttctaggatattcgaaattctgtgactcctattaatgtatcattctcctggggcatcacagctgaggctggtgtaggctcactagtagcccagcctggaaaacaagctactcagcacactcctcttagcttggctttgttgtgtgtgcacttcatgagggtgatgctgcccatgtgatattccagatgtaggtgagtctccagaacggacag

SEQ ID NO: 205517 - DNA, 601 bp, Human
atctctactaaaaattcaaaacattagccaggcgtggtggtggaggcctgtaatcctagctgctcaggaggctgaagcaggagaatcacttgaacctgggaggcggaggttgccgtgagccgagattgcaccattgcactccagcctgggcgacaaaagcaaaactcttgtctcaaaaaaaaaaaaaattctgtctaaattccagtgatgatcagatgtgaacataaacacgttcaggatcatatacattgctggatttgccatatctgactttgtctgtttctaggatattcgaaattcwgtgactcctattaatgtatcattctcctggggcatcacagctgaggctggtgtaggctcactagtagcccagcctggaaaacaagctactcagcacactcctcttagcttggctttgttgtgtgtgcacttcatgagggtgatgctgcccatgtgatattccagatgtaggtgagtctccagaacggacagcagctacagtagtgtatcttttagagagcacggaagagttgcttaaaacttcttttctattcaactcttcatcagaggtactcttcatgacctcatctattcattcatg

SEQ ID NO: 205518 - DNA, 601 bp, Human
atcttttagagagcacggaagagttgcttaaaacttcttttctattcaactcttcatcagaggtactcttcatgacctcatctattcattcatgcaacagatatttactaaatgtttacgttgcaatggacatagtagaatgaatcatcaaaagcttgttattatatattaggttgattttttccaggagaggagtttaggaagacattcagtctccttggtaaacttgtacatgcctttactgtcagccttacttaaccctttacgctatataatatgctttctctcttaattttctcamgagtttgcaagccccttgaggggtaaagatggtatctcaactcttcgcagttctattttatgcaaatagaggcagtggtggctaattgatgattccatcatccagaatatcttatgcctctagcttctgactgacggagactctgttttttaacagatgatctgaaatgagtttgctgtaggttctttgctgtcttggtcacccctggacatgattggtattctgcatgactatcattggtagtggtagcatggtatcgtaaaggcaaggatgtaaagagaaacaaactcgggcttcagg

SEQ ID NO: 205519 - DNA, 601 bp, Human
atagtagaatgaatcatcaaaagcttgttattatatattaggttgattttttccaggagaggagtttaggaagacattcagtctccttggtaaacttgtacatgcctttactgtcagccttacttaaccctttacgctatataatatgctttctctcttaattttctcacgagtttgcaagccccttgaggggtaaagatggtatctcaactcttcgcagttctattttatgcaaatagaggcagtggtggctaattgatgattccatcatccagaatatcttatgcctctagcttctgastgacggagactctgttttttaacagatgatctgaaatgagtttgctgtaggttctttgctgtcttggtcacccctggacatgattggtattctgcatgactatcattggtagtggtagcatggtatcgtaaaggcaaggatgtaaagagaaacaaactcgggcttcagggtgaaaacctttggctctcctacttggaaaatggacttgacctgaaaaatgagaattaaagtctacatctttcagggttattcagaaagttaaatgaaataaaataaatataaagtgatgaggtgaaataa

SEQ ID NO: 205520 - DNA, 601 bp, Human
agttataccaaatgaaaacaaatgactgaagaagaactgaatgatgtttataagccttttatatgattttttaaattgagtttttggtctcctaattgattaataaagggaaagacagagaagactgacatgtgttatcttctgtcacagttcagatagagtgaaatgactcccaccttgccaatacaattctcaaggttgattgctaattttaatttatctgaaccgtgcttttcaatgaggtgatattggtcctgatcgttctgtaaattggagattttgcccgaggaagttaattctsccctttcacaaaaaaagtttggactttcagatgacttatttgacattagcaatgttagattcttgctccactgcagctctgcctggccactctctgttctttttgtcactgaattctctgaagcgtgtttgactctgcttaggggacccccatcactaagcctggggtctggttaccatggatcttaggcagtttggctgctatagcagcataccgtaggctgggtggcttcaacaacaaatttatttcctcacagttctagaggctggggaagtccaagatcaaggcactggcagactt

SEQ ID NO: 205521 - DNA, 601 bp, Human
ctgggctttgctgcctaccagctgtgtggcccttccagcgtgaacctgtccagacctgagttttagtatacccacagtggggaaaaaagacctacatcacagggttattgttaggcttaaaggacgagacagatgcaaagtactaagcatgtggcctggcacaggggaagtgctcaggaaatggtagtgactgttaagactgtgatacttggaggctgaaccttaacaggatattatcctgacctgtcagtttagctctttggatcctatggtttttttttgttgttgttcttttgtttgytttttgagatggagtctcgctctgtcgcccaggctggagtgcagtgtcacaatctcggctcactgtgacctctgtctcctgggttcaagtgattctcgtttctcagcctcctgagtagctgggattacaggcacctgccaccatgcctggctaatttttgtatttttagtagagaaggggtttcaccaccttggccagcctggtctcccaactcctgacctcaggcgatctgcccacctcagccttccaaagtgctgggattacaggtgtgagccactgtgcccggcctggatcctatct

SEQ ID NO: 205522 - DNA, 601 bp, Human
gatggagtctcgctctgtcgcccaggctggagtgcagtgtcacaatctcggctcactgtgacctctgtctcctgggttcaagtgattctcgtttctcagcctcctgagtagctgggattacaggcacctgccaccatgcctggctaatttttgtatttttagtagagaaggggtttcaccaccttggccagcctggtctcccaactcctgacctcaggcgatctgcccacctcagccttccaaagtgctgggattacaggtgtgagccactgtgcccggcctggatcctatcttaaaggamtttctgtggtgataaattatgaaatgcctttctcgtgccatccgacctcctgtgttcactctctgcacctttctattgtttcactggaagtgtcatgatattccatgagcacgttggttgctattaccacgtaagacaatgggaaaaaagaagcctccagcttctgggtgtttaccgtttggaaacacagcacaacacttgacattctcagtgctgagctcatgtagaggcagcagacagactgcagatacgtgcctgtcctgccccattagctgcttcgcaatgggggtttcagtttat

SEQ ID NO: 205523 - DNA, 601 bp, Human
ctatggtcaggcaaaggtatggttcatgatcccaagcatataacatgcacaccagctgaatataagatgaaagcaacattctgtgcattcgcgtgcccctatgctaaatatacttaggttgacccatatgaaattgccatttttatgggcaaagagagccaaatatcggtaattccaagtggttcagcccagcacatgtttgcatatacgcaaactggcagacgcagttctggaattttgttgagacatccccaaagtgtttcacaggcctacagacacgtgggtcttttcacagaggcayaacgaaccatgcagaaaggtagaatcctcagatgctttatctaataatcacagaactgaagatccagaaggatccttgggggctgcgtgttgcactgtggttgtttaatagaagtaggccccatgaggtgaggggacctgcatgtcgggtgagttagggctgactgtgaggctgggacttaggcctgtgtggcatctggaacactgtattctatccattttaaattttaggccatgaaagtgagtaacacatgggctgtaacttagaagtcaactaagtgataagggcttgcagtcacgc

SEQ ID NO: 205524 - DNA, 601 bp, Human
ttcagcccagcacatgtttgcatatacgcaaactggcagacgcagttctggaattttgttgagacatccccaaagtgtttcacaggcctacagacacgtgggtcttttcacagaggcataacgaaccatgcagaaaggtagaatcctcagatgctttatctaataatcacagaactgaagatccagaaggatccttgggggctgcgtgttgcactgtggttgtttaatagaagtaggccccatgaggtgaggggacctgcatgtcgggtgagttagggctgactgtgaggctgggacttaggcctgtgtggcatctggaacactgtattctatccattttaaattttaggccatgaaagtgagtaacacatgggctgtaacttagaagtcaactaagtgataagggcttgcagtcacgctgggcacagggaccccgggcagagaggagctctgcggtgcagagaggcacattggtgaagggagccaggcattcagccacatggtagaggagggcgtccttatctatctcaactagcttctgctatcggacttctggggagaaagggtttggtgttcaaggcctaacattgcctttcctctc

SEQ ID NO: 205525 - DNA, 601 bp, Human
ttcattccaagattgtggtatactgggaaataagagaattcaatgaaaagggcttctataacaaacgaactaacccattagaaagaactgaccataagcttagtaggaatcagtcatgtgatgttgcagctaaaatagcgaatgctgtggttttcaaacttgtctaaagtgggagaccccacttcctaacagtgttctgatttgggaccttgtgcacaaagtgggcagtgggagtggtgactggggaggtataaggagcttagagcctggatgggtgcctgccctgccccttccaggtaascccctgaaacttgaaaaccattatgttaatacgttaattatatagctatagggatcccttaagtaaatacaaagttttattactgtagaggcatgtttttatacattgttttatttgaccctgaagaagagaccgcaaaggcattatctctagtgtctgtatttttcatagaaggaaactgaagatcagggagattagtaccatgatcaagagcacacaggtaatgcataaggcagcagggattggaatgtgacttagtttagtgctcatttcactgggtcacaggcgtatatagatgaa

SEQ ID NO: 205526 - DNA, 601 bp, Human
tgggagtggtgactggggaggtataaggagcttagagcctggatgggtgcctgccctgccccttccaggtaaccccctgaaacttgaaaaccattatgttaatacgttaattatatagctatagggatcccttaagtaaatacaaagttttattactgtagaggcatgtttttatacattgttttatttgaccctgaagaagagaccgcaaaggcattatctctagtgtctgtatttttcatagaaggaaactgaagatcagggagattagtaccatgatcaagagcacacaggtaatgcrtaaggcagcagggattggaatgtgacttagtttagtgctcatttcactgggtcacaggcgtatatagatgaaataagagccttggcttcttggagctggtcagactctttctggattgttttgttcagtgatgggtggtaaattggagaatgttgagagaggcgtgactgggatgtatccctgtgcagtacagatagaggtgaaagattttaaaatggatatctctttgagaggtaattcattggtgtcagctggtttcaataaaggtgctatctaaagaaaaaggtgctatctacagaa

SEQ ID NO: 205527 - DNA, 601 bp, Human
ggtgatctgaattgcaagaatatttcctattttcccatgggactaaattaagttatttgcattttgaatggaatagaagactctaaacacatttatttttttcttcctgaatcatccttggaaaaagaggttgctcgctgttgatttatttcacaattttatctgggtaaaagccacttgcaaaaccactccccttatcttagtacaactgtgctagtgcagaactaaggccaaagggtggaaaattccgtgagagtgatttggattcactcttaaaatgatagcagcagcagcagcagcragactcacagcagcagagctagctaccagaaacaggtggccctagagctccttgtccccagaaatacacaggtagaggctgggtgctgtcagtctcagtccctgaggagtagacctctgtgttgggtgttacattaggccagtctgttcttttgagatctaagattctgttattttaaaggctttcattactatcccattagaaggatcaatttgaatttcttgtatttgagtggaaaatgccgaagaatactgaggtttgagtttctgatgttttgtgaatttttcactgttgatattt

SEQ ID NO: 205528 - DNA, 601 bp, Human
ctaaaaagaagcttaactcctttaagagagaagtacgttctactttgctttaaaaaaataagaacagggacataaatctatctaatggctaaaaatagaaatgagtgattgaggatgaaaaagagaaggaaagagaaagatcacagacacagacacactcggagacttcacagtaataaagaaaaaaaatcaaggactcagagtgagacacagacaaaacgagccatacacctaaagatgaatatatgcaaggcaggcaaacggaagtcctttttgggggctgtgcaaatactggtgtaasataagaaaaggtgatgggcagatgcagtgagttgtagagggcctgttctgtccaaaggcactcaaatccaacaaaccctgcgctcaccaaaggaaattcatctgtcatccactggccaccagcgtagaccctgggttctgaacacccacagaaatgggagtggacgttatactgagtgcttaccctgtgccaggcctggttctgtgtgcctcgcccctcacgccttataatcctcacatcaccgtcgggaggcctgtgcaactgccatttccccacttcagaggtgaggaagcagaccta

SEQ ID NO: 205529 - DNA, 601 bp, Human
gtcctcttctttcacggggaaagaggagctgaaatgtgcttaattgtttgctgcatttcctgtgcacatgtacttatccctcacatcacccgagaccaagtgaagagggagtgtttagaaaaaagagagggaggctgatacccgttgaaagtaaaatgctggcatcttaattttaagagaacacagaaagccaaatgctttcagaaaagggtcccttcacggagtaatttgcctggtatggcatcccagtttgttgtataatttcagccccgttactatggtaacctgctttagtgtcgcrgcgattgttaatcaggatttgtcgttattcccctttcatcacgaggctctatatccttatggattaaatcgcagttctcatcgacaatggcatagatcaaacattattgccagacataaaaccccgggtcgctccctgtcattttccccgttaccagaagcagcaaatgcaagctgaagtctaacttttgcaaggaaatcagggctccttctggctcctctgatatctaccctcatgacagaattccaagcaagagggccactttcgtttccaatcaccctgtgcccatgggaagggcaa

SEQ ID NO: 205530 - DNA, 601 bp, Human
tgttgaggatgttctgtggtgaatcacagagcctcgtgaggctcgtgggatggtggcttgcttttcccatttgtgaagtctggtggtaacagtacccagacagggaagtgaacaaccctatagtatagtgaccggatttagcagggccggatcgccaccatctttaggaaagtcaggttaaaggaacataggagcggtgaagtctcgtggtgccatgttctaggttaggtgcatatcgctagtcgtagtgtgtcttcatattgcaaattgctttgtttaggagcgagaactgttaagccaygcttgttaatagcctctggagccagtctgcctgggttcagtgtttggctctgccacctcctaggtgtgtgaccttggcaagtttttgaacctctctgagtttcagtacctaaaaccagcgtaatagtagtacctacctcagagtccgtgaggatgacgtaagttaatatttgtgaagcgcttagactggtgactggcacgccatcagtgttgtataggtgtttgtaaatagatgaaacagaaccaacattgcacgtacatgtattcaaaatatattcaagatcagattatccaaatacca

SEQ ID NO: 205531 - DNA, 601 bp, Human
gtgtgtcttcatattgcaaattgctttgtttaggagcgagaactgttaagccacgcttgttaatagcctctggagccagtctgcctgggttcagtgtttggctctgccacctcctaggtgtgtgaccttggcaagtttttgaacctctctgagtttcagtacctaaaaccagcgtaatagtagtacctacctcagagtccgtgaggatgacgtaagttaatatttgtgaagcgcttagactggtgactggcacgccatcagtgttgtataggtgtttgtaaatagatgaaacagaaccaayattgcacgtacatgtattcaaaatatattcaagatcagattatccaaataccagtaaggtgttgaaaacagcgcttccccccctcctcccccttccctctccctgctttttttccttgatctctgcaatgtgcccaacccccaagtataattctgattggctaaattaattctgcagcatcctgctgtgaataattatgttgatccagtgtgtatctcatgcctttttttttctctttgcctaaattataatgtgacaattgcggctcacagctggctcatcagaggtgggcagttgggg

SEQ ID NO: 205532 - DNA, 601 bp, Human
agctgctgggctcgttttgggggagggggcatgtaggagtctcctttcccctccccccgcctctccctgcttttcctttcagacaataaatagctgtcaggcttatgtcaaggatgaaattataggtgcacatgaggccttgattacattgttttggagagattgctattagcatactgaaatgaagtctaatttttcactggcggagctgagtcaaactccagggacaggcagggcctatgcagtgcgaggcgagaaccgtccgatcggagcacctgttctatgtggggatcagcttttmcttccttaagacaaacaataggaataaaataattcatacgaagaatagctttgcattagaaaagaaaggccaactgataaaggatggaataagacatttcggttagataaggctctttgtgaaatgaccgtatatgattttcaagtgtgtttaatccatgttaaggcagcatctcgcttgttgattcaggctgtgttttagcctgaagagtgtaccatctgattttttaggttgcttgccgcctgcataattcattttctactgcccggccctgcaagcaggcatcctctgaagaggcgt

SEQ ID NO: 205533 - DNA, 601 bp, Human
gttctctccctgggatgctcttgcatcggtagagaactgtgagtaaaacagctgctgcctgaaatccagacacaggaagcaggtgagtggctgctgagggccgagggctgggggtttcgaggaaactaggagtggctggatgcaggtaccaggggtattttgggggtgatgacagtgttctgaaatggaatgtggcggcggttgtacaactttctgaatagactaaaagccatcggattgtatactttaaatgggtcagttgtatggtatgtgaattatatctcagtgaaggtgttatttwaaaaaaaaatactgctgcatactgatgaaatcacactttctgggcgtggcgctggtctgagcctccttaggagccctgggctggagcagacgctggacatagcgttcagctggaaggagaggtggggctttatcttagcctggaagggcttgctgaaaggtttgcaaaacctatttgcaaaagggagccattggaagttttaaagtagggtcttggcacattcacactattgtttaaaaagctactcacagacctgtggtagatggtttctggaagctgggacgccagctggggccttgt

SEQ ID NO: 205534 - DNA, 601 bp, Human
atgtgttggattcaaggaaccggcgatccatcctggagcaagatgggaatgtggctctgaccccagcaaaggggctggccaccgagcctagggagtgtggagggtcagcttccgcagcagctcagtcatcagctgttggcaggaggcctcagaccttcaccacgtaggcctcaccacctctgtccccatgtcctcacaacgcagtggctgacttctcccaaggcgtgtggtccaggaatgagtgaaagtcacagtgtctttatataaccctgcctgggaagtgacacactctgtctcctaygggtgacgccaaccaaccgtgtacagggtagaaggggtcacacagggcatgagaacaggaggcaggggccatggggctgtcctggggacagtctgccacctcttgatgcctggcactgctcttggcatggccatctgcatggaaaggctgtaacgagaagggtgctcaaccaccagctcacaggcagggaagcccatgctgcctggaggattcctgcattctcctagcatctgtggcaccccccacgtcccaggggctcggagacaggtcaccgtttctctggactgtcactccagcgag

SEQ ID NO: 205535 - DNA, 601 bp, Human
ccagctcacaggcagggaagcccatgctgcctggaggattcctgcattctcctagcatctgtggcaccccccacgtcccaggggctcggagacaggtcaccgtttctctggactgtcactccagcgagttcaccgcccttcgactctgagcagtgcagagaccccggaccacaacaaccgtgttcctcagactgatgcgaaactccaaagagcgggaaaacgactttagagggaccggaaaggggaagcgagtctcccatggtttgaggtgttgctgcccgtacctgtgcacttggccacrgtccaaagtgactccattgcgggcacagccgtggggctgacgtgagaccccagcctggcaaagcgagcactcggaggcagtgggcagaaagggctcctctcggctctgcagccggaaaggagacatctttttagataagagttacagataatattctatttctggaaacgcaaggatgggtgggatgaaccttcttaactaatgtgatccattcagaagtatgttaaaatgtatcccttcatataatgcaccctgctttaatttttagatcagggctgaagagtttttcttttttttttt

SEQ ID NO: 205536 - DNA, 601 bp, Human
aagtctggctgaaatttagaatctttgaaggaaagcgatggtgagattatttagactgggaagatgaacctgccaatcttatttcttattctgcgtgtgtcacttgatgagaaggccatgtctccaccctttagtaaaggccaaggtcatttaaaaggttacctggcctttttaagtgacttgaaatgtttagcacagttttagaaggtcagtgtctcaccacctgacccttatttccttggtttatgatggccaatttattgcgtctgttttattcaaaagaaaactgagggtgcttctraagtagtttcttatttcaatgtgtacacacctccactctgaaacatggctcccttaactgcacaggcaaatttatcacatgtagttgtgaacatatatttgtgtgtgtattgcagtggaaaatccccttgaaaaatcagcaaattggacttcagcttgaaaagtatagacagagaacaaaactgtctgtgtgcaaatatatgtatatgtgtgtatctaaaaacatatataaacacatgtatacgtatgtatatataaataaaattggattgagtcataaaagtataaatatgtccaatgt

SEQ ID NO: 205537 - DNA, 601 bp, Human
tggaaaatccccttgaaaaatcagcaaattggacttcagcttgaaaagtatagacagagaacaaaactgtctgtgtgcaaatatatgtatatgtgtgtatctaaaaacatatataaacacatgtatacgtatgtatatataaataaaattggattgagtcataaaagtataaatatgtccaatgtaaaatctactagagaaggagtttgtttttatgactcagagggaatgtgtaataaagaggtatttttaagaccgagagccagtgtgtgtcagcttctttttgcccattgtttgtgtsctgggcaggaagatgactcactagatctgaatcacaaggcaattaagagccccaggaaaggctgatttcaggatggatatttagaagcttcagctaaatcaggtcttgggtatctaggtggattggggaatcagtgaaacaaatatttctcttcattgttttagattctgtggatctcttgctcagtacagaagtactttttttcccccaaaaaatcatatgaagaaagaggaagcgctgcccattctgaaggaggttgttaaaaatgagtaacgcacacttcatgttcacagcagcagt

SEQ ID NO: 205538 - DNA, 601 bp, Human
aaaatccccttgaaaaatcagcaaattggacttcagcttgaaaagtatagacagagaacaaaactgtctgtgtgcaaatatatgtatatgtgtgtatctaaaaacatatataaacacatgtatacgtatgtatatataaataaaattggattgagtcataaaagtataaatatgtccaatgtaaaatctactagagaaggagtttgtttttatgactcagagggaatgtgtaataaagaggtatttttaagaccgagagccagtgtgtgtcagcttctttttgcccattgtttgtgtcctkggcaggaagatgactcactagatctgaatcacaaggcaattaagagccccaggaaaggctgatttcaggatggatatttagaagcttcagctaaatcaggtcttgggtatctaggtggattggggaatcagtgaaacaaatatttctcttcattgttttagattctgtggatctcttgctcagtacagaagtactttttttcccccaaaaaatcatatgaagaaagaggaagcgctgcccattctgaaggaggttgttaaaaatgagtaacgcacacttcatgttcacagcagcagtatt

SEQ ID NO: 205539 - DNA, 601 bp, Human
gtgaatgtacttaccactactgagcggtacacttagaaatggttacgatggtaaatttaatatgaggtgtctttcaccacaattacaaaagtggaatgagtgaagcttattaaggatagacagcagatggctgagaagttggcctggctggaccgttgtctggggggagcatgtggatgaggcatgaggtggggaaataaggaacctgtctttcttccagttaattgttctttcccccttgccttccaccttcctttccctcctgatggctcatcctgtctccctctcacgtgcctgctgyatactttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacg

SEQ ID NO: 205540 - DNA, 601 bp, Human
aatgtacttaccactactgagcggtacacttagaaatggttacgatggtaaatttaatatgaggtgtctttcaccacaattacaaaagtggaatgagtgaagcttattaaggatagacagcagatggctgagaagttggcctggctggaccgttgtctggggggagcatgtggatgaggcatgaggtggggaaataaggaacctgtctttcttccagttaattgttctttcccccttgccttccaccttcctttccctcctgatggctcatcctgtctccctctcacgtgcctgctgtatrctttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacgctg

SEQ ID NO: 205541 - DNA, 601 bp, Human
gaagttggcctggctggaccgttgtctggggggagcatgtggatgaggcatgaggtggggaaataaggaacctgtctttcttccagttaattgttctttcccccttgccttccaccttcctttccctcctgatggctcatcctgtctccctctcacgtgcctgctgtatactttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacgctggctgctcttccatgttgcccccttcataacaaagtgttcgctatcacgttaagaaatatgttcgaggaggaagccgtgcaacagcttcagaaaaaaattctagagctagaacatgcagttggttttcaaat

SEQ ID NO: 205542 - DNA, 601 bp, Human
cccccttgccttccaccttcctttccctcctgatggctcatcctgtctccctctcacgtgcctgctgtatactttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttsccaaagcgacagcagtggtagcacaggtgagggtgtcgcccaccgtctgagaaacccatgaagtacgctggctgctcttccatgttgcccccttcataacaaagtgttcgctatcacgttaagaaatatgttcgaggaggaagccgtgcaacagcttcagaaaaaaattctagagctagaacatgcagttggttttcaaatctcatattcttaatttcaatccttttatttcggatccaggctttaggatgcctctctctctgatatcactaaataaaaattatccaaatgtttaacatt

SEQ ID NO: 205543 - DNA, 556 bp, Human
tatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacgctggctgctcttccatgttgcccccttcataacaaartgttcgctatcacgttaagaaatatgttcgaggaggaagccgtgcaacagcttcagaaaaaaattctagagctagaacatgcagttggttttcaaatctcatattcttaatttcaatccttttatttcggatccaggctttaggatgcctctctctctgatatcactaaataaaaattatccaaatgtttaacattatatagaaataaacataatggtgtatttgacaaaatttgacaattttcatgtggatatt

SEQ ID NO: 205544 - DNA, 601 bp, Human
gttgagggatgggaatttgtcaaacgcagtcactgaatctgtgtggtggacacgcgtgcttgaaaaccttgcggaagagtagccatcaaaaatacttacagttcttaccaaggttacggcaggggtgaccacccaataaggtagcacccaaatcggcttcactgcttcaatacgatggaaggctcaaggacacatttgtggttttttttttcttttctttctttcttttttttgagactgagtcttgctctgtcgcccaggctggagtgcagtggcacaatctcggctcactgcaagctcygccttccaggttcatgccattctcctgcctcagcctcctgagtagctggtactacaggcacccgccaccacgcccaactaattttttgtatttttagtagagacaggatttcaccgtgttagtcaggatggtcttgatcacctgacctcgtgatccacccacctcggcctcccaaagtgctgggattacaggcatgagccaccgcgtccagccaggtttgtgttttataggaagaataaatttccattttaaatgaaacaattctacttttttcttgtgaaataatgttgaagtatagat

SEQ ID NO: 205545 - DNA, 601 bp, Human
cgcagtcactgaatctgtgtggtggacacgcgtgcttgaaaaccttgcggaagagtagccatcaaaaatacttacagttcttaccaaggttacggcaggggtgaccacccaataaggtagcacccaaatcggcttcactgcttcaatacgatggaaggctcaaggacacatttgtggttttttttttcttttctttctttcttttttttgagactgagtcttgctctgtcgcccaggctggagtgcagtggcacaatctcggctcactgcaagctctgccttccaggttcatgccattctyctgcctcagcctcctgagtagctggtactacaggcacccgccaccacgcccaactaattttttgtatttttagtagagacaggatttcaccgtgttagtcaggatggtcttgatcacctgacctcgtgatccacccacctcggcctcccaaagtgctgggattacaggcatgagccaccgcgtccagccaggtttgtgttttataggaagaataaatttccattttaaatgaaacaattctacttttttcttgtgaaataatgttgaagtatagataaaatatatcaattgtatgaagat

SEQ ID NO: 205546 - DNA, 601 bp, Human
ccaaggttacggcaggggtgaccacccaataaggtagcacccaaatcggcttcactgcttcaatacgatggaaggctcaaggacacatttgtggttttttttttcttttctttctttcttttttttgagactgagtcttgctctgtcgcccaggctggagtgcagtggcacaatctcggctcactgcaagctctgccttccaggttcatgccattctcctgcctcagcctcctgagtagctggtactacaggcacccgccaccacgcccaactaattttttgtatttttagtagagacagkatttcaccgtgttagtcaggatggtcttgatcacctgacctcgtgatccacccacctcggcctcccaaagtgctgggattacaggcatgagccaccgcgtccagccaggtttgtgttttataggaagaataaatttccattttaaatgaaacaattctacttttttcttgtgaaataatgttgaagtatagataaaatatatcaattgtatgaagatcatttaaagaaaatcacatgtatattgaaaaagattttaatttttttttcttggaaatagtgatctattgttttaatggaaaa

SEQ ID NO: 205547 - DNA, 601 bp, Human
taaaatacacccacgctctctctctcactgttgtggttgtatcaactgaagagcctagaagctgtgccatcccaatacgcacacattctctctctctcacttttctagttgtatcagctgaagagcgtagaagctgtgccatcccagccattatgagcatctctcatgcccagatcttcgtttctgaatttctctttccactagaagaaaccatgagagaaatggcgagcctgagatcctttattgcaccaaaagcaaggaagtatggaaggagagctgagggcttgccaggacattggcygacatggtctctcactggtcaaacttgggatggttggaacatcaataaagaatattaatgatcatggattataagtacattaaaaaaacccatatgagtccacagtgatgagagttgggctggagcagggaggggaaagctctgctttataggaacatgccagataacaaatatagaaggagttagagaattagaaactcctcatgttataaccttaatgtaatcaactgattcaggatggatgtgaaaactattggatgagaggctgttgatgttagcacagtattctctgtgcttttg

SEQ ID NO: 205548 - DNA, 601 bp, Human
tacctgaagcccctgggaagagtggcttcgatgctgccaaggagaatgtcatgaagtacagagctaagtgcaggaactgtttcagattagggagaccaagcagaaataacagccaattgcagtgaatgaaacttggtcggattccatatcgaaacaaacaaaatggctataaaggacatttttgagacaatcggggaaatgtgagtgtggactgtatgttggatgatggtattgaatcaccctttccttttttaaaggtgtgactggataggagaaggtgtttattcttgagagatgcctkttggattacttagggtgaaatttcacaaggtcttaagtccagttttggatagtttggtaaaaggaaagcatgtgtgtgtacgtgtgtgtatgagagagaggggatttgagaagatattaattcttggtgaatgtaggtggagagttatcagtattcaatgctatatcgtttgtttctgtaggtttgatatttttgaaaataaacaataagtaaaactaagtggcatagaaattaatctcttcttttcatatggacacatagagacatggtgctaggatggcatgtgggaaatagtttctg

SEQ ID NO: 205549 - DNA, 601 bp, Human
attaattcttggtgaatgtaggtggagagttatcagtattcaatgctatatcgtttgtttctgtaggtttgatatttttgaaaataaacaataagtaaaactaagtggcatagaaattaatctcttcttttcatatggacacatagagacatggtgctaggatggcatgtgggaaatagtttctgcaagatgagcatattcttcctccactgcccctaccagagaaatgtgaatgctgattcacttcttttgaccagtggtgatggaatagaattttccagtcatgcagttgtacttattkccttctggttctgtatcgataagcttcattcctttttttttttttttttagcttcattctttagaaattggattctttacttagtcaagtctataatcaaaatagactttccatggtaagtaaagtaacatgggagcgcataacaatacctgtcatttatgaagacctactgtgtgcttggcactgtgctgtgcttttatttaagtcttctccattcttcatcatccccacattaccaggaggagacaggctcaggatgacaagtggcttttgcaaggccgcgtggtgaatacatcgtag

SEQ ID NO: 205550 - DNA, 601 bp, Human
tcagtattcaatgctatatcgtttgtttctgtaggtttgatatttttgaaaataaacaataagtaaaactaagtggcatagaaattaatctcttcttttcatatggacacatagagacatggtgctaggatggcatgtgggaaatagtttctgcaagatgagcatattcttcctccactgcccctaccagagaaatgtgaatgctgattcacttcttttgaccagtggtgatggaatagaattttccagtcatgcagttgtacttatttccttctggttctgtatcgataagcttcattcttttttttttttttttttagcttcattctttagaaattggattctttacttagtcaagtctataatcaaaatagactttccatggtaagtaaagtaacatgggagcgcataacaatacctgtcatttatgaagacctactgtgtgcttggcactgtgctgtgcttttatttaagtcttctccattcttcatcatccccacattaccaggaggagacaggctcaggatgacaagtggcttttgcaaggccgcgtggtgaatacatcgtagatttgaaatttaaacccagttctttctgactc

SEQ ID NO: 205551 - DNA, 601 bp, Human
tttttttttttttttagcttcattctttagaaattggattctttacttagtcaagtctataatcaaaatagactttccatggtaagtaaagtaacatgggagcgcataacaatacctgtcatttatgaagacctactgtgtgcttggcactgtgctgtgcttttatttaagtcttctccattcttcatcatccccacattaccaggaggagacaggctcaggatgacaagtggcttttgcaaggccgcgtggtgaatacatcgtagatttgaaatttaaacccagttctttctgactctartttacctatatgttcatcctccagtatcatgctacctgtatgcctggaaataaaccattttacatagtttctaatgggattacatttttaaaggaaattcatggtagtaaagatctcgttaacactcccttgatgtatggtatttgagtttaagtgtgaaaagaagacactagcaatggacttgtactgagattcaggaaccctggcttctgcttccagttctctcactgtctgatggtgtgatttgagggccttagtcttatcaaatataatcattggttggtctggttgatatctcag

SEQ ID NO: 205552 - DNA, 601 bp, Human
tccccctctctctgcccgccctcttcttctttctctctctccccatctccctgtctctctcttcccttccctctctccatccctctatcttttaataacagctgtattgacatataactcacataccgtacaattcatctatttaatgtgtacagttcaatggtgtcttattccattgggctactataacagaataccatatactgggtggcttatatgcaacagagataagtttctcacagttctggaggtggaaagtccaagatcaaggagccagcagatttggtgtctgatgagggcmcacttcctgcttcatagatggcaccttcttacggtgtcctcacatgctggaagggcctcttttataagggcactaatcccatccattagggccccatcctcatgactgactaataacccccaaggctccacctcctaatactgtcacattgtgaggaaagatgtcaacatctggacttcaagaggacgtaaacattcagaccgtagcaaatgggtatgaactgcagtcagacagttgtgcaaccatcaccacagtcaattttaaaacgtttgcattacctcaaaaagaggccccatagct

SEQ ID NO: 205553 - DNA, 601 bp, Human
ggtgtgctatttttcagtcccacctgcagaggattccagtttatccacatcctctccaacgcttgctgttgtctgtgtttttgattatagccactctactgcgtgtgaaatgttatctcattgtaattttgatttgtatttcaccaatagccattggagggttttagggatgaaatggcatgatctcatttagattttaggaagatcactgtcaccgtatcaaagaggatggatgagagaggtgcaggcagattaccagataccagatgatggatggcagcagacaggccaaggtagtggyagtaagaatggtgagaagtgagtggattacaggggaatctagaaatactgtccgtaagaatttgtgattggtcagatgtgaggattggggagcgctgaaactgcatttcctgcctgggcacctgcgtgaggccatccattgacagaggggacagagcagggtgggtagtggagagtggtgtgtgcagatctggaggggttgagtttgcatttactatcaagagaggagatcaggagtggtctctgggctggaggcagacatttgggaattgttaatatatatcagcagtatctccagaac

SEQ ID NO: 205554 - DNA, 601 bp, Human
gcagacaggccaaggtagtggcagtaagaatggtgagaagtgagtggattacaggggaatctagaaatactgtccgtaagaatttgtgattggtcagatgtgaggattggggagcgctgaaactgcatttcctgcctgggcacctgcgtgaggccatccattgacagaggggacagagcagggtgggtagtggagagtggtgtgtgcagatctggaggggttgagtttgcatttactatcaagagaggagatcaggagtggtctctgggctggaggcagacatttgggaattgttaatatrtatcagcagtatctccagaactgggaatggctgaggttggagagtgagaggaaactaggatatttgagcttacctcttacttctggagctttgtgatgcttttgcccttttagaaaaatgcatggaagtacagttttttactcaatatggaatacagttaaagaacaacatttccttcactttattgaaatttgttgcaggataacatctctgtcaaagcactttacaaggctttctagtaaagtaaattttttgtgtattgcagtggggagaggggagggggttgcctcttgtaaggca

SEQ ID NO: 205555 - DNA, 601 bp, Human
gaatctagaaatactgtccgtaagaatttgtgattggtcagatgtgaggattggggagcgctgaaactgcatttcctgcctgggcacctgcgtgaggccatccattgacagaggggacagagcagggtgggtagtggagagtggtgtgtgcagatctggaggggttgagtttgcatttactatcaagagaggagatcaggagtggtctctgggctggaggcagacatttgggaattgttaatatatatcagcagtatctccagaactgggaatggctgaggttggagagtgagaggaaacyaggatatttgagcttacctcttacttctggagctttgtgatgcttttgcccttttagaaaaatgcatggaagtacagttttttactcaatatggaatacagttaaagaacaacatttccttcactttattgaaatttgttgcaggataacatctctgtcaaagcactttacaaggctttctagtaaagtaaattttttgtgtattgcagtggggagaggggagggggttgcctcttgtaaggcagaatttgattggcattatctcttaagtcttcatttccagcaacaatcttaacatgc

SEQ ID NO: 205556 - DNA, 601 bp, Human
aatctatatagatctctatagataggatgaatccatgacacgtccttaaaacagttttattttttccgtttcatgaatttagcaggaggatcctattctcactgcaacctctgccacccaggttcaagcaattctgcgtcagcctcccgagtagctgggattacaggtgactgctaccacacctggctaatttttgtatttttagtagagacaggatttcaccatcttggccaggcagatcttgaactcctgacctcgtgatccacaccccttggcctcccaaagtgctgggattacaggyatgagccatcgtacccggccgagatttcatttttaaaaaacatgaatccaagaagtgacttgagttccaaataaataaatttataaatttacttatgttctagaataaatgcaagtaattatgactgcattagtgcagcattaattaacattgctaattctttgtaattatgccaaataataacactaataaaatgtaaatatcaaatgaataaggcgagagcctcccctcctctttttaaagccactatattacagtgtcagattatgaacacacaatattatcaagcttccagatatc

SEQ ID NO: 205557 - DNA, 601 bp, Human
ctagaataaatgcaagtaattatgactgcattagtgcagcattaattaacattgctaattctttgtaattatgccaaataataacactaataaaatgtaaatatcaaatgaataaggcgagagcctcccctcctctttttaaagccactatattacagtgtcagattatgaacacacaatattatcaagcttccagatatccactttctaaatacggtctgtgtgaattctaatgaaaacatcagctctgtggtataaatctcctttgccgcctggttcaatgaggggctgcccagcaagscaataattccattcctcagagcattgctgagaatatttatataattaaatatcatctgtttccccatttaattcctggtggctatcccccaaccccctggctgtttttgctgtttccttgggcaggaatggcacaataaagttgctgcagtgctgatggattatcttcattaggtacttgggtgatgagtccccaagcactgctgaatttgatttaccctgtgcaaaggcccaaccttccatagaagcgctaagtagggcaggttttatgcagcttgaactggttggtgtgaagaagaag

SEQ ID NO: 205558 - DNA, 601 bp, Human
ataaaatgtaaatatcaaatgaataaggcgagagcctcccctcctctttttaaagccactatattacagtgtcagattatgaacacacaatattatcaagcttccagatatccactttctaaatacggtctgtgtgaattctaatgaaaacatcagctctgtggtataaatctcctttgccgcctggttcaatgaggggctgcccagcaagccaataattccattcctcagagcattgctgagaatatttatataattaaatatcatctgtttccccatttaattcctggtggctatcccscaaccccctggctgtttttgctgtttccttgggcaggaatggcacaataaagttgctgcagtgctgatggattatcttcattaggtacttgggtgatgagtccccaagcactgctgaatttgatttaccctgtgcaaaggcccaaccttccatagaagcgctaagtagggcaggttttatgcagcttgaactggttggtgtgaagaagaaggaaaaaattaagttgttcttctagaaaacaattttgggaaatgctttggtctcttaggagagcctcctttgcctccttttatacaatct

SEQ ID NO: 205559 - DNA, 601 bp, Human
ttttgggaaatgctttggtctcttaggagagcctcctttgcctccttttatacaatctcaacaaatggtgatactgaaagtcctttttggtaagaagaggcggatgaagtgagaacgtggtgagctggagagaatgcaggagacccgggttctgcatctggggtcagagctgaagccaggctgaccttccttgggtctcggggtgtctgcatctgggcagcgatggaacaggactgtggctctccaaggccacttcagctttggagtgggaccttcgtgaatcccgccctgcccctgatarccatgggccctgggcaagtcaccccatctctccccgcctctgacactttgtctttaaaatgggaatacaccacttgttttgcccacttgttacagggtggtccggaggtctgaatacaagagcgcactgcatggtcctgtgcggatcccagctcgcagcaggtgcccacaggacgccgcccctcgcttccctcatgtcctagattctgtgagacacagcccgtgacactttgaagcagggccgtaggaattccgatgggaggtgattagagagaataaacaaagtgacggagttgggcct

SEQ ID NO: 205560 - DNA, 601 bp, Human
ggtgagctggagagaatgcaggagacccgggttctgcatctggggtcagagctgaagccaggctgaccttccttgggtctcggggtgtctgcatctgggcagcgatggaacaggactgtggctctccaaggccacttcagctttggagtgggaccttcgtgaatcccgccctgcccctgataaccatgggccctgggcaagtcaccccatctctccccgcctctgacactttgtctttaaaatgggaatacaccacttgttttgcccacttgttacagggtggtccggaggtctgaatacragagcgcactgcatggtcctgtgcggatcccagctcgcagcaggtgcccacaggacgccgcccctcgcttccctcatgtcctagattctgtgagacacagcccgtgacactttgaagcagggccgtaggaattccgatgggaggtgattagagagaataaacaaagtgacggagttgggcctgagacaggggagtggtctgcggtggaacagtgctggagtaactcctgccactctgagccaaggctcttatttatttttattttggacagggtacttgcagaatcaaggctttgggagt

SEQ ID NO: 205561 - DNA, 601 bp, Human
acctgactgctaccacgaagggtgtttaacctacattgagtgccaactgtgcttctcctttaattcaaagcctttgatttctgggggtgcctgttctgatggcactgatgggcaccccctgttgagtggggcaggtgacgggaggaggactggcggccgtcagtgggggctaccatgggggtccagggggcctgtcaaactgtggcacaggggaaacccgtagctctgtgccttactattttactataccatctcatttagtgcccacgatttcttaagaggtaggcactgaaggggaaayctgtagctctgtgccttactataccatctcatttagtgcttatgattccctaagaggtaggcactgaaaccattaccatttgtagatggggaaaccaagggtcacagtggcttgcccaaggccacacaggtcataggtgggagaactcattggagccctccccgcctcagccacgacagtcgtgtgtaaaggtgggttcacggaatatcatggggcctcctgtggtcttaaagtttgcacctctccaaattcctaggttgaaatcctagcccacaaattcgtaagttagtatttggggag

SEQ ID NO: 205562 - DNA, 601 bp, Human
catctcatttagtgcttatgattccctaagaggtaggcactgaaaccattaccatttgtagatggggaaaccaagggtcacagtggcttgcccaaggccacacaggtcataggtgggagaactcattggagccctccccgcctcagccacgacagtcgtgtgtaaaggtgggttcacggaatatcatggggcctcctgtggtcttaaagtttgcacctctccaaattcctaggttgaaatcctagcccacaaattcgtaagttagtatttggggagggggctctgggaggtgatttgttaygagagtgcgaccctcatgaatgggaccaagagccttagtgcctgcctgaaagggacctctttgcaccatgggaggacacaatgggaggttgaccaactgtagtccagaagcgggcttgtaccagagcctgaccatgctggcaccttgatcttggacttccagcctcagaaccatgagaaatacacttgtggtgttcataagccacccagtctgtggcagttcgttatagcagcccccgccgactcagaccacgctgtaggatttgaagcaggtgtgctgagaatgtagggtagacatgtc

SEQ ID NO: 205563 - DNA, 601 bp, Human
aattctaatgtgcggcctaggttgagaagatcagctcttagaagaatacagctggccgcctttttgctttatacgttttgagctgctggcttctaattagagttaatatcattacaatataatgcctttgttttacattaaatttaataagaacaaccactctgctctccaacaatatagctactttctctggcttaagtgcttctattctttttttaaaaaacaaacaaacaaacaaacaaacaaacaaaaaactgagtttccgattaaaaacccaagcttaggccagaacagaactttkgaactgcagtcaaacaaaattttagataattgttttctaatggcttcctgacaaatggagactaaagacaggcaagggggctaagaccaggctgggtggggagaggggacagcagcacgttggtacctgggtcacctgccagaaaatgagtggcagtctgtgcccaggtggcttcaatttcctgataaaatgaaaaagccatgatatctctgtagaccgagtctacgtcctaacccccaaatcaggacacatagtcttgtaagtgggagagtatacacgtggacattgtagctggaatct

SEQ ID NO: 205564 - DNA, 601 bp, Human
tcctagggttgagaaacaactggctgtattcacccaacctatgagaagaggatgaggtgacatggagaagtcagtttacaagagctggagcaaagtgcagagccaaatatcttggcgctgggctaatgatgcccttttcattctcccctcttcttcttccctcctctccattctcttccaacactgcttccccaggtcccctctcccatgccaggaattaaaatgttttgtctggaaacaagtgagcttgactaacgtggccgggctcccactgcagctgagttctgcatgttctgatgtyagtgttgtgagctttaactggagattggtgtccaaaggcagccgatactgctctgtccatttctgttgtgctgaaaatcacatggaaaccaatcacataatgatcttgggaatgaagtattcaatgcacagtgttattaacatgtaaaagacttagggcaaatcacttttaagtatgacaaggcttcagatgtgtttggtttgagtatagggaaaagagtttggggggttgtttatcagcagtgccatgagggaggcttatttcttccctttaaatctggatgaatatgcctgtgtgcgc

SEQ ID NO: 205565 - DNA, 601 bp, Human
cccacccctaaggaaaaaaacattgccactgccctagaaggccctataccctgatgttatttaagaaaatggaccgcggaagagaggcacatgggtggccaggaatggagaagctctgttaggacttgggcatggcacttcttgactgtttctgatctttatgaggcagtagggattctggaacccaacagtttgggttgcaatctcatctatgttacttactagctttgtgtccttgggcaagtccctatgctccttgtgccttagttttcctatctgtaaaatggagataataaaagtrtctaccttgtaggataattgtgagcatatcaagtgtgttaatacatgtaaaatcattaatacagcatcaggcacatacatgttaactactattactttattaataatcttggttctaaaaccttgtgttgttttatatgtggaattcccagtcttctaaacagtatctctctctatagatgactgtattatcctggtcttccacgtcgctggtgtgctatcatccctggccaactcagatgtcactgggcatctccagcacagccactgttcttccttccactccatgcagaatgtggca

SEQ ID NO: 205566 - DNA, 601 bp, Human
ctctctatagatgactgtattatcctggtcttccacgtcgctggtgtgctatcatccctggccaactcagatgtcactgggcatctccagcacagccactgttcttccttccactccatgcagaatgtggcagcctggcacacaaataatttttaataaaattttagtgtataaatgtggtttttggaaagtagggaggagggaagtagcattgatttaatatttaaacagtaccatttaaacctagtagcaaaacccctatacgataatgagttgtagtctattttacagatcaagaaartgaagctcagagaagggaagcaactggcccaatgtcacatagctagtaagtgactcagctgggattcgaccacacttctgttttcagaagtgcccatcccttgcggggatttgagctctcacagcccagcctcccatccttgcaggaatccttccttccacactcccaaaaactgaccatgtaggcttcactaaagtaaatcataaatttggaagtctaggacatcttgaacatgctaaatatgtatcaatacacctgatatattgtttccagtcacagataattccagttgattttcag

SEQ ID NO: 205567 - DNA, 601 bp, Human
cagtgtatcaaccatttgcaaagcatttacattgtattaggtattgtaagtcatctagagatgatttaaagtatatgggaggatgtgcataggttacatgcttatactgtgccattttatgtcagggacttgggcatcctcagattttgctacctatggggttttggaaccaaccccttgcaggaactgagggacaactatactgttgtttatgagccatccatttttatggtactctgtccaatcagcccaagttggctaagacatagatgatcatgtcttctgcgaataatgatagctkatttcttcctttgctatctcaatgaattttacttccttttcttattgtgctagctaggctctccagcatgatgttgcataggcgtggtgagagtggatatcttcccctagctcttgatccgaggggaaagcagtcagtttttcaccatgaagaatgatgccagctgtaggtcttttgagagcactgtcatttttacttttatttttggcacatggatgggaaggctaaagacttgcaactgactttcctcctatacctttaacattttgctgaatggtagagaaagagaagctgggccag

SEQ ID NO: 205568 - DNA, 601 bp, Human
tcattgtaatagcattctaataattctgttaacaactgcttgaaatcagaaagtattatttctgttgtttagatttgcccaagcatttcttgtgtaatgttataagctgtttatgtgcctcttaatagatgagagaatgcactatgtgaagtctgaagtatctgaagtaggtaatggaaccagaggaacttaggttatgagatgggggtatataggtaatatcccatatatcatagtaataacaagacatagaaactaatatactcactcccagatttccatggggactaggaggagcctscattgtagccggggtcaggaatggcagggtggcagaactacagatgcatgctccctccatgccaatgtgtggaaagggagtgacggacaaaggcagtgggatctggtcacgggagtatgggttggtgtgtgtcaccctgcatggggtatgatactgggctgctacaggagctcatggattccagatcagcaaaggaatgccatttaggaggccttgggaggtgctgatggggttggaggggtggcaaaagccagaaaagatgggactggtaggaaggacatggctcctgggcttcattct

SEQ ID NO: 205569 - DNA, 601 bp, Human
aaagaggttatgtgtgagaaggggacagatgggaccagtcattctcagcataacaccgagtggaaataaccatgacacagattggagcaaagtgaggaggtgaagcagggagaggatagggaagaagaatattctaggtggagagaaagagaaagcatgtataaagaccatttaaaatagcacacttctggagggccacctttttctcacagcaatctgggtcttacagccctttttctgttcaaagtcttccttaatacaaactgttttatttaaaatcttagtgcttttggttcgactrtgtgatctttagctttacagtgagaaggcggttaaatgccagggcccctctgagccgaaggctctccgtgtctgcctgcagcctttgttctctgccatgtaaaagatgaaaaattgtgtcagcaatatcacacccagttactgtgaaatcaaggaatcgctctggtgaagaatctgggggtgaagaccagacaaatcgaaacggcttggcgtcatgatttaactttgtcaagccaaagagagggctcgtgtttcaatagttagcctcaccttgcatctatactgggccaagtcttctttc

SEQ ID NO: 205570 - DNA, 601 bp, Human
tctcacagcaatctgggtcttacagccctttttctgttcaaagtcttccttaatacaaactgttttatttaaaatcttagtgcttttggttcgactatgtgatctttagctttacagtgagaaggcggttaaatgccagggcccctctgagccgaaggctctccgtgtctgcctgcagcctttgttctctgccatgtaaaagatgaaaaattgtgtcagcaatatcacacccagttactgtgaaatcaaggaatcgctctggtgaagaatctgggggtgaagaccagacaaatcgaaacgkcttggcgtcatgatttaactttgtcaagccaaagagagggctcgtgtttcaatagttagcctcaccttgcatctatactgggccaagtcttctttccgtgaatcctgaaccctgaaggaatcggcctcctctggctggttttaggcattgcccataaatcgaggctacaactgttctccaggcatctccctgacacctcaaacgtatgctcagcactccttgggccccatgcccaggaatctttccgcttgtctcttttccgggcttgcagccaggctcaacttttcaagatgttgtctt

SEQ ID NO: 205571 - DNA, 601 bp, Human
aaactgttttatttaaaatcttagtgcttttggttcgactatgtgatctttagctttacagtgagaaggcggttaaatgccagggcccctctgagccgaaggctctccgtgtctgcctgcagcctttgttctctgccatgtaaaagatgaaaaattgtgtcagcaatatcacacccagttactgtgaaatcaaggaatcgctctggtgaagaatctgggggtgaagaccagacaaatcgaaacggcttggcgtcatgatttaactttgtcaagccaaagagagggctcgtgtttcaatagktagcctcaccttgcatctatactgggccaagtcttctttccgtgaatcctgaaccctgaaggaatcggcctcctctggctggttttaggcattgcccataaatcgaggctacaactgttctccaggcatctccctgacacctcaaacgtatgctcagcactccttgggccccatgcccaggaatctttccgcttgtctcttttccgggcttgcagccaggctcaacttttcaagatgttgtcttccaaatcctgccttgattaactcaatctgcagccccttctttgtcactgttttctt

SEQ ID NO: 205572 - DNA, 601 bp, Human
cctgtctagcccctttcccacaacttttctgcactcaccctcctctactatggccgtcccggtcacttcaccatcttggagcacctggcactcatgagatgccacgatggtcacactgcatcccttccctgaaaccttcccagcctgtctcggtcattccattgttttatttgacttcctctagaatcgataatctctgctacacaatttagcatgtaaccgtatatgctcagtgttccctttttgaagtatattggtcttatctccgcaattggaacatgtttaccctgttggaacatamgctgttatcaagtcacaacgatcattatttttgctttccccaaagtgtcaagaatgtaacacaggatcaacaagtgttgactaattgataaccgagattccagattaaagacaaattttagtctgatgatcttaaaagtaattatgctgggtggaaaataccctcactttgggtatggttaaaatgactatcttgaatatctcattaagaggataatgtctcattgacatttatactgacagcccctagcatggagccttacgtactggctagtgtgttgaatgaatacctgacttattt

SEQ ID NO: 205573 - DNA, 601 bp, Human
ggatatggtggaggataaagaatatgattatttgaatcaagatgcttatggtatggcatcctagagtcgattgctttttaaaagattcttgagctttgataactttttgttgatacattttctttgagttcagcgagctggcttcatgagtgtgttgttatccacctcttctttgggaggaaaggattgtgttttagtacttaccctgatggctatagaagtcactgtttcatatgctatatcagaattgacttaaaaattgcatgtaggtatttgctacatgttttggtgacatgatgtrtaccattaaggaaatttaagatctttttgatcacaaagttctcagcttacatctggttatttgttggcgttttatttattggcaagctttttctagcagcaggtctatggacagccctgaaatttctttaaaaaccagtcttggaaagaagaaaagctgtggatgcttagttgaaagttcaagttacctgcaaaacatttgtttcaattgaatttgtctatctatagttgatgtagagtgggattttagggaccagggagtgtctccttggtcctaagttaagaaaacaaaaataaagtg

SEQ ID NO: 205574 - DNA, 601 bp, Human
acttcctgatagatttcgcttagtttaccatactctgacagtaaaaatcaaatgaatctgagctgcttaacattaacattccaggccggacacggtggctcatgtgtgtaatctcagcacttcgggaggcctaggaggggagatcacttgagcccaggagttcaagaccagcctgggcaagacagcgagaccctgtctctacttgaaaaaaaatttgaaataaaaacaaaaacacaataacattccaagcaggaaagtaattgaaaaaaactgctatcatccatattgctaattttataaygcggaaactaccacagagttataagtgcagcgatgaagatataatagacatatttttgtgtaagaaaaatgaaaattcaccttagtgactgaaagcatagattgactttgcatagacatcagtgtcaataatgatcattttagtaactcaggttttgtttcttcagttgaaattcaaagtaacccaggttcataagtaggctgtgatgttgaaagattggaaactctcaattttgtcaaagattggaactaggttgagatactttggaatgttttactagataaagaggcagggaaataa

SEQ ID NO: 205575 - DNA, 601 bp, Human
aaaaaactgctatcatccatattgctaattttataatgcggaaactaccacagagttataagtgcagcgatgaagatataatagacatatttttgtgtaagaaaaatgaaaattcaccttagtgactgaaagcatagattgactttgcatagacatcagtgtcaataatgatcattttagtaactcaggttttgtttcttcagttgaaattcaaagtaacccaggttcataagtaggctgtgatgttgaaagattggaaactctcaattttgtcaaagattggaactaggttgagatactktggaatgttttactagataaagaggcagggaaataaaataactgttgtttcctgtgatttgagaactacaggatggcaccagaatctcagacctgcagcccagtgaagggattccttcattaaggctcttgttcatttctttcttggtaattttgttggttttctgtttttactagaggaatatgactcttaggaatcatacctgcatgcaaatttctgatgctctgttgattcgtgagcactagaaagagttaaaactccctatttctcacaatctcccccttggcagagttcagttca

SEQ ID NO: 205576 - DNA, 601 bp, Human
ttgtgtcataattgtatatatttcgtgtatttttgtctggtatcagacactgttggaaattgtggtttagtttacttcagttgttgcaccgaagaaatgtacaggaaatcaggtgtttttggaagacactggattaagagctgtactaaaatgctccatctatttcttcactacttccaaatgttgccacatttttgaaattggaaaattctgttttagttgacttcctggactttacctcttgtgtatgacttcaatcttgataacgttccatgctagtcttcgtctctggacttctctrtcaaatccaccgttaacccatcaaatatttattgaactctaggcactatcctagaaactggagataggtgagaatgagaaaaattcgtctacagctcccagtaaatacttgtccgcagatgggaggaggggacagaacataacctgtaagcagatatattataatttcagatagtgctacatgtttcaaagtaaacttaaagcagaaggcctggcagggagcagaaggggatgctattatctagagagcaagggtttgagtagaaacctgcatgaagtcagaaagtgaaatatctgcagg

SEQ ID NO: 205577 - DNA, 601 bp, Human
ctaaaatgctccatctatttcttcactacttccaaatgttgccacatttttgaaattggaaaattctgttttagttgacttcctggactttacctcttgtgtatgacttcaatcttgataacgttccatgctagtcttcgtctctggacttctctatcaaatccaccgttaacccatcaaatatttattgaactctaggcactatcctagaaactggagataggtgagaatgagaaaaattcgtctacagctcccagtaaatacttgtccgcagatgggaggaggggacagaacataaccwgtaagcagatatattataatttcagatagtgctacatgtttcaaagtaaacttaaagcagaaggcctggcagggagcagaaggggatgctattatctagagagcaagggtttgagtagaaacctgcatgaagtcagaaagtgaaatatctgcaggagaaatgttccaggcagtaggccagcaagtgcaaacaccctgtgggggtaagaatcttgagatgatcaaaagacagcgtgcagtatagcttgtgcacacgtaccctaaaacttaaagtataataataataaaattaaaaaaaaaa

SEQ ID NO: 205578 - DNA, 601 bp, Human
gagtagagtcaggaggcaattcactagcagaggaaatagatgaacttgctgggtcatgatggaggtggtgagaagtggtcgtggtccagacgtattatgaaggtcaagctggtgggacttcctggggtcacatagaggtagtctcaccaacagtgttagtgctctggagacctcacttctacccttgggtcatgtacctgcatgggaaaagcctttatcctgaccccaagtgccttggctcaacttcgtgattggtgtgcattttgggtgagtgggggtgagcaggagattaagtaagaawtttttttttctcttcaaaatacagacatatgggtgaaatacaagggtggggcagggagaggatatagttctcttggtacatgaccccatctacagctcctatctggatctcttggcttagctctgacctcctaactttttgaggctggggactagacagggaggtgattgaaaggcttcagggacttgcttggtttatcctctaagctgcagcagctatgtcaggtttcctgattcctgaccccaattccagatattcctttatttgacttacagaatgactaagaatatgcaaagtgag

SEQ ID NO: 205579 - DNA, 601 bp, Human
ctttgaagcagataatactgtgtagaccaagtctttaaaatagcacattccatgagccaaccagccacctcacctgcctataacattttcctttatcgtctccactgatgctatagctgaccatgttaggaaccctcatgttatagcttagtttatcttaaatcttgactttgtgtttgctcttagctcttgaggactatttgccttcctagacttggtactcccttgactccctcagtcccagccaggagagtgtcattttaggccattgtcacactaggatgtaggaggtgataaagacagcttagttaggcttaggaccaaggctgtgtgagaaccaaccgaagacagacctgcaatgtgtcatctggtacttacggcctctgtttgccaggggctaagtgtgataatgggtcagaaagtataaggtttacaaagtagctgagatgccacctgggacctactattaaaagccagggcagaatcctacaactaggaggtcataacagtgcttggaaggccattgaagctacagtcaggggcagaccaagggtctgggagcttgaagaagtggcggtcaaggcaaaaatggttcaaaata

SEQ ID NO: 205580 - DNA, 601 bp, Human
gccttcctagacttggtactcccttgactccctcagtcccagccaggagagtgtcattttaggccattgtcacactaggatgtaggaggtgataaagacagcttagttaggcttaggaccaaggctgtgtgagaaccaaccgaagacagacctgcaatgtgtcatctggtacttacggcctctgtttgccaggggctaagtgtgataatgggtcagaaagtataaggtttacaaagtagctgagatgccacctgggacctactattaaaagccagggcagaatcctacaactaggaggtcmtaacagtgcttggaaggccattgaagctacagtcaggggcagaccaagggtctgggagcttgaagaagtggcggtcaaggcaaaaatggttcaaaatatagaagttcagattgtggagaatagcaacattagtaagcagagagtaggagacaggctgatctctggctaggttatttgtccccacactttcttttttcaatcttttttcccactctaccctggaagcccaggcctagatacagaggcatagtgtttttctctgcgagctaaagaggacggtgtggcatcagggtgacaagc

SEQ ID NO: 205581 - DNA, 601 bp, Human
gttggtgttggtagtggttttttgttggtgttattgtgagtggtagtgttgatggtcttggtggtggtgctgttagtgttgatagtgatggtgtgttggtagacttgatagtggtgttattgttgatggtgttggtggaggtggtgttgttgccattggtggtggtcgggatggaagtggttgtgttgatgattttggtgttgatggtagtgagcagttccctcactgctctcttacacagccagcctcttaaataatccccactcttaccctctaagccccaccttagacactaatacaytctaaacctcttccaaagaagcagaaagaatcagtttcctgcctgggaacagtaaaccttgataactactttctctctagatgtaaaaggtttggctggtgttattctcggtgaaaatagcagaaaatccttctctttccagactgggattaaatggcttgatttacattggattctagggttattattatttttaacacttccctgatcggtttttttagaaactagcaagacatttttaaggatgaaggcatattaaaaacaactctaaggatgccttgtctgatgcattcagcttgc

SEQ ID NO: 205582 - DNA, 601 bp, Human
cagctgtctgcaaggggcatttcatcagtatgcatcacgactggggcttggcagtcattagaattcattataaattactctgagtcccaggaatctcatttagttctccctcagcagctggaagatgctaccagctgtggatctagggtttcccccaaagattttacctaagcattgtgggtaggggcaaataggcaaaacgatctgatgatgagtgggtggggtaagatggacaaccctgtttctgcctttctacctcagagttaatgccctgaagatgccactgggggaatcagctcttggcacagcttaatccttagtgcttctggtgggccgaggaatgctcaagggtgtctttgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctca

SEQ ID NO: 205583 - DNA, 601 bp, Human
agctgtctgcaaggggcatttcatcagtatgcatcacgactggggcttggcagtcattagaattcattataaattactctgagtcccaggaatctcatttagttctccctcagcagctggaagatgctaccagctgtggatctagggtttcccccaaagattttacctaagcattgtgggtaggggcaaataggcaaaacgatctgatgatgagtgggtggggtaagatggacaaccctgtttctgcctttctacctcagagttaatgccctgaagatgccactgggggaatcagctctgcgcacagcttaatccttagtgcttctggtgggccgaggaatgctcaagggtgtctttgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaa

SEQ ID NO: 205584 - DNA, 601 bp, Human
taccagctgtggatctagggtttcccccaaagattttacctaagcattgtgggtaggggcaaataggcaaaacgatctgatgatgagtgggtggggtaagatggacaaccctgtttctgcctttctacctcagagttaatgccctgaagatgccactgggggaatcagctctgggcacagcttaatccttagtgcttctggtgggccgaggaatgctcaagggtgtctttgtgagtcattgcgagaaggtccatgacagaagagggaaagaaccaaagagagagcaatggagaagaaagtwgcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaccccttatgattctcacaacagctccataagataggggtaatttccattcattttttttttcagagaaggaaagcacaactcagaggggtt

SEQ ID NO: 205585 - DNA, 601 bp, Human
gaatgctcaagggtgtctttgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaycccttatgattctcacaacagctccataagataggggtaatttccattcattttttttttcagagaaggaaagcacaactcagaggggttattgacctgtgcaaaggaggagttctgggttggggggagtggaacccatgggagctgcacactcagttcctttgtcccctgaccatggcactttccacacaatactgcatacgtatcggaacagcgtgcctcttactgatccttaccgtgttggaccaggacacagtggcaaggtgagccaggttggccttctgtgctcctggcctttcc

SEQ ID NO: 205586 - DNA, 601 bp, Human
tgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaccccttatgattctcacaayagctccataagataggggtaatttccattcattttttttttcagagaaggaaagcacaactcagaggggttattgacctgtgcaaaggaggagttctgggttggggggagtggaacccatgggagctgcacactcagttcctttgtcccctgaccatggcactttccacacaatactgcatacgtatcggaacagcgtgcctcttactgatccttaccgtgttggaccaggacacagtggcaaggtgagccaggttggccttctgtgctcctggcctttcctcacgtggcccttttccta

SEQ ID NO: 205587 - DNA, 601 bp, Human
aggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaccccttatgattctcacaacagctccataagataggkgtaatttccattcattttttttttcagagaaggaaagcacaactcagaggggttattgacctgtgcaaaggaggagttctgggttggggggagtggaacccatgggagctgcacactcagttcctttgtcccctgaccatggcactttccacacaatactgcatacgtatcggaacagcgtgcctcttactgatccttaccgtgttggaccaggacacagtggcaaggtgagccaggttggccttctgtgctcctggcctttcctcacgtggcccttttcctatcatgtattcacctctt

SEQ ID NO: 205588 - DNA, 601 bp, Human
gtatttcttcccatagtgttttgattacactaagcgttaccggcaggcaatagttatttgctattattgtttttaaattaatcctagaaggtcctttaagtgtatttgataaacatcatgttacctgccagcaaggaattgtactctggatatttctgtcttcagaggtagttctatagtagttctgttgtataacagaaagaactatcaattatttgatcttacagtcattatacatgtagactataaattcatgggatttaatttaatgaacaggttcctgcctcagaactttgaacaktatgctgtgggaaggaaaatcttttcaatttgctttacagactttgagtatttgtaagttcaccttttaaacaattagggaatatttacatgttgaggatttctcacaagattaaaaaaaatacttcttttgaaatagttgaagactgaagagaagctgcaaaaatcgtacatagttccaatgtgcctttacaccagcttcccccaatgttaatatcttacataatcagtgtgttgtcaaagccaggaaatgcacattggtgtaatacttttaaatacagatcttatttggatttcacca

SEQ ID NO: 205589 - DNA, 601 bp, Human
ttccacaattacggatttcgagtgaatgaaagaaaaagaatggggaactgtattcaggttgtgagcactttcacatttatagctacgatccatttaaagttaattgtcgtataaggtttgacgtaagagttggggtttattttgtcccatttagatatacagttgttccagcaccatttgctgaaaagactgtcctttcctgattgaattatctcagcacccttgtcacaattaaatcctgtcttctctattctgttccactcatttgtagaacttatgccattaccacactgtcttgatkactgtaaccttacagtaagtcctgaaatcaggtagtggaagtattccaactgatagttccaaattgtttttgctattttaggtattttaatttttcacttaaactttagagtcaattcatcaatgtctacaaaaacctttctgaggtttccatcagctttgtgctgaactacagattaatttggaagataattgacatcttacagagtctttcagtttatgaacatgatgtatctttccattgatttctatatgctttaatttctctcaacagtgttttatagttttcagggtacagacc

SEQ ID NO: 205590 - DNA, 601 bp, Human
cactgtcttgattactgtaaccttacagtaagtcctgaaatcaggtagtggaagtattccaactgatagttccaaattgtttttgctattttaggtattttaatttttcacttaaactttagagtcaattcatcaatgtctacaaaaacctttctgaggtttccatcagctttgtgctgaactacagattaatttggaagataattgacatcttacagagtctttcagtttatgaacatgatgtatctttccattgatttctatatgctttaatttctctcaacagtgttttatagttttsagggtacagaccttactgacattttattaaaaatctccctagtatttcatgttatatgttgttattatgtaaagtacttcttttaaaaagaaattaacatttcatttgttgctactatgtaaaattatagtttatttttgcatactgacctacatttggtgagcttggtaaactttttagtacaaatagcttttttccttaggattttttacttacacaatcatgttgtctgcgtataaagtattttccttctttcatttttgtacgatttttatttctttttcttgccttttttgaact

SEQ ID NO: 205591 - DNA, 601 bp, Human
gttccaaattgtttttgctattttaggtattttaatttttcacttaaactttagagtcaattcatcaatgtctacaaaaacctttctgaggtttccatcagctttgtgctgaactacagattaatttggaagataattgacatcttacagagtctttcagtttatgaacatgatgtatctttccattgatttctatatgctttaatttctctcaacagtgttttatagttttcagggtacagaccttactgacattttattaaaaatctccctagtatttcatgttatatgttgttattakgtaaagtacttcttttaaaaagaaattaacatttcatttgttgctactatgtaaaattatagtttatttttgcatactgacctacatttggtgagcttggtaaactttttagtacaaatagcttttttccttaggattttttacttacacaatcatgttgtctgcgtataaagtattttccttctttcatttttgtacgatttttatttctttttcttgccttttttgaactgactaggacctcactacaatgtcaaatagaagtagagtgagtgtaaaccctagcttcattcctaattt

SEQ ID NO: 205592 - DNA, 601 bp, Human
ctcattcctcagtgatgagtagcacaatgtggagatttctgtctatagttagtagctgaaaggcttaagcaaggatgggaaatgtattcttttcccctatcctagcttgcaaccagcttgaccagtatgtaagggtatgttcttgatgttatagggtagaaattagaatgcttttctcactgaaacagtattctgtaaatggtgctcagggtccttggaaagaattatatatgagactcattatgggctgaggaggcccttctgggcaagtttaccaccgtttataacagcatgttcatggaaaatggtttctaaatctcagacacccatttcataaacatgcttttgaaatgtgactcatttttaaattgggggtttgcccatattatattatgttctccccagaaaccttctcaacaatagtttacattttgagctataagccttttgggaagaaaaagtgacagaaaatagagattactataatttagtcttggcactaatatcctggcagacctatcaagacataattctcctcgaaatcagatttactgcaaggcctatgctgaagtcttcttatagctgaggtatgccaagtcac

SEQ ID NO: 205593 - DNA, 601 bp, Human
aagtcacactcgtcttctacatttctagaattctagggtcttattcaggtgcttccaaaaacatctgatcagaattagcacatgagaaacattttgggcctgccttagaccccattcagcgcatggctttatggaggcctatggccttcccgctgagagagacactgcgcaggctccagagtgggttcagtgtgaggccgcctcctctgtctcccctgtgtttgatattttcagacactgcggtaattttattcagcaaagctccattcagtcattacagaatccatcaaagaagtgtccmttgctagaatgtgcaagtttttattgagcatgtattcagggacgataaccaagcagacggtgctgctatccctaatctccatctgttagtgaagtcaggcacccagcagtgtgtttaaagagccactaccatctccactgacttccctgagttaagatgttctatttcgcctccatctttcatagaaaggcaagtgtaaaaaagcaccaccaagcgcctgtctgtgtcgtgtgtagaaccaaagtggaagattttgttcattatgtttcttaatatgaatatgcgctgggttatccaact

SEQ ID NO: 205594 - DNA, 601 bp, Human
gttttagactcaataggaaacacatgtcttagtataaaacaaattccttttggtctatagccatgtgtttcagtacacctactttcaacgttgttattcacaagggtgtcacaggcatcaggctgaaatacagattttaatccttaaaataaccttattttcattgtcatttatattctcaagattatctaattttggtagtcattaggaattacttgtgttaatagtggtggtgagatttcataaaagtcaggtggaaaatttccatcaattaatgtaatattatatgcttatcacagaygcctaagttagacatggtacttaaatgtggcaattaataaaagtattacaaaggtgaaaatggatttcttctaaaaatggaattaatgatgatggagtgcttgtgttgggaactcaggctagtctggtgcttgccggagatgcaggatgcttggagagctgcaggcagtgctgtcaacacagaggcatgtgttgacgtgtctgatcagcaaccctaagaagtgggtcgggcattgcgggctggtgaaggctggagagagggccagggttgtctttccgtctgtatcaccaccagtaagca

SEQ ID NO: 205595 - DNA, 601 bp, Human
tgtgtggggtcattcagcttatttacagtttttctgtattttaaacagttctgttgtaaacatctctggaattctttgtctcaattctgattatctcctacagtagctatttataattgcagtgactaggtcgaagggtggaaatgcttttgacattcttggttggttgtggtagttgtggcagggtctcctctgtcacccaggctggagtgcaatgggacagtcatagctcaatgcagcttctaactactgggctcaaatgtttctcctggctcagcctccctagtagctgggaccacargtgcacaccaccatgcctggctaacttatttatttattttttgtagcaatgggagtctcgctatgttgcccaggttggcttttggcattcttggtacctattgtcagactgctttccaattagattgtagcgtttcatgtgccatgagcagtgtaggagaaagcttgtctcactgaagcctggtcagtgctcggcattgttttcgcaagtttgccatttgcacgaatcaaagctagtctctcttttgagactgagcatctattgtgtatttatataattaacaatttatctgcataatat

SEQ ID NO: 205596 - DNA, 601 bp, Human
aatgtggagaacatccttgccagggagtgaacatgagccaaaggacccgcctctaggtaccagcttatgcctcaccaaggtgggttactgtgctggctgggctttcagcctggcctgttctgcccatcctattgtgacctcttgaagctcaggcttgttcttctgcagaaagagctgggaggtatgggggttgcctggggaggtatgggggttgcctgagctgggcatcggctccattaccagccgggaggtgtatctccgttctgctgcgtctggagcaaagggagcgggccagatggtmgtggagggcggggttgactgcggggaggccgtggtcagagcaagaggataaaatcctgaatgacacctgatttgtttttcgtgctgtgatttttcactgttgtccaattgtcctctgtttttccatcacataccttttgttttgggggcagcccccacttgcatatggtccctggtcaccatgggggagagcagtgagctgccttccccttcacctccagctttgagagtaaatctcaccttctgggtacccacagcagctggggacatttgccttattcccaccatggccttcctgggg

SEQ ID NO: 205597 - DNA, 601 bp, Human
aaaataaaaagcaatgtcagtatcatcttcttaagcttttgaacatgtccccccgatccccttcaacatccagaagttgactttgacccagtcttggtctaattaactgctactctgcaagcactgcgctctcaagatgaatgaaaatctgtttcttgtcctcatatcttcttggtggaggacacgtcactgccatcagcagaggttgtcctcccagagcatgtggctttggcatgtgccccttgtagcagagaaggggctggggcatgtgcccaacccaccagttgggaggcacccactstgctatggctgggtaacagatgtccctgttggagactcttgtgtctccatttgacactctactggtaatcaatagttagggctcaattaatgaatggcttttctgtttaataaatttgtttctgtggtgaaacatgccattgattttgaaacaaatttgtaaatggtgggttaggttcccaggttagcccacccttcccccatatcttactgaacctatacgaagggtttaaaggatctttggttctttggcccccaaatacttgccttagcagaatttcaatgagaaaatgtctttaaa

SEQ ID NO: 205598 - DNA, 601 bp, Human
gctctcaagatgaatgaaaatctgtttcttgtcctcatatcttcttggtggaggacacgtcactgccatcagcagaggttgtcctcccagagcatgtggctttggcatgtgccccttgtagcagagaaggggctggggcatgtgcccaacccaccagttgggaggcacccactctgctatggctgggtaacagatgtccctgttggagactcttgtgtctccatttgacactctactggtaatcaatagttagggctcaattaatgaatggcttttctgtttaataaatttgtttctgtggtgaaacatgccattgattttgaaacaaatttgtaaatggtgggttaggttcccaggttagcccacccttcccccatatcttactgaacctatacgaagggtttaaaggatctttggttctttggcccccaaatacttgccttagcagaatttcaatgagaaaatgtctttaaaaactccaccttggtttctaggaatagagctggggtcatttcttggttgtaaagaacttgctattttcccattgtggagtggaaagtagctctcagatttccccttattcttttatccctagagcaat

SEQ ID NO: 205599 - DNA, 601 bp, Human
gaaatgagaaggaaaatgacttcttcccctgtgccatctttgttttatccatttaaaccagcaatggcaaaatgatttcatcacacatgatgcctctaagcgatgagactctatgggtactgtgttgagaaaagattctgtgggcacattcagggatcaagaaagtatgctgtgtttgattagtgatgtctgccatgggcatggtcgtggaggggaggtgactaatgtttatttgccgttcctgaaacagacctgttggaaagtaaagttcacacaggtgataataccagcctaactgttwtatagagtttgttatgtactggacactgttctgagtgctttttgtatttaattctcaaaacaccccatgaagtaagtacaaatgaggaaacttaaaatgaagaaattcttacagatgaggacacagaggcatgaagaggttgagtgactaagccaagatcatatgggtaggaagtgggagagctgagagtcacagtcaggccgtcttgtcctggatcgcctgttcttagccaccagttctgtcctgtctcctgcttgtgagtgttgtgcctgcggtccacaggactgatgtaagactcag

SEQ ID NO: 205600 - DNA, 601 bp, Human
tggatcaaataagttatctttcataatggctaaagagagattttttagtaccatttacctcactcgttaatttaacaaatactcatcaaatgcccgttctgtgtccatacgctgagagaggattatggaaatggggagtcagagagctacgacccctgccctccctgagcttgcagtctactgatagatgcagtccctgtacaaacagtggcataagtgcaaagtgctacttgggtgagtgctgcagaggaaaggcccttggtcctgagggatcagggtggctgtggtggatggatgaggratgctagtgttctgaccatgcaggtgcttgcaggccatgccaaagagctttgactgtggcctgagagtcatgggatgccatggaaggggaggaggggtcttggagtttgtgtcacatgattagatttttttccctttggaaagataattgtggctaccttgggaagaatgaattggacaagggatatacaagagttagaaggcagatgtcggagtccggaaaaaggggtcatgacatttggggctagggaggcttcggtaatgaaaaaaagaagtgagggggatgctacaggtgtctgga

SEQ ID NO: 205601 - DNA, 601 bp, Human
ggatgctacaggtgtctggagggggacagtcgctggctgtggtggcagattggatgtggggagtgaaggaagagaagggataaggacagttagaaagcaggagcatggcaggcccattcccaaaggtgggggatgctggcacagaagctggtttgggatgggaggacatcctgtgtagttttgcggtgttcagaggagatgtcagatagggtgcactttggattgtgaacatgtgggtttcagctgggccatcgacagaccttgatggattgtcctgggaaaccaactactgtggaaaaartagaaaaatctataattttcatttgtttgaattcaaacattttcaccctagacaaaaagaaaagaatctaacaatgagaaaggaaataaataaaaataaatgtcttgcatagtctttgtgttttcatttttatgttcttctgccagtcttttcacataaatattcatattttaattagttgtcattatagtctatgtagaagttgtaataggattgtgtttccttaccattatcccaaatattttcccacatttctgtatctctctcaaggctgcatttaaaacatgttgggtaatattc

SEQ ID NO: 205602 - DNA, 601 bp, Human
aaataaataaaaataaatgtcttgcatagtctttgtgttttcatttttatgttcttctgccagtcttttcacataaatattcatattttaattagttgtcattatagtctatgtagaagttgtaataggattgtgtttccttaccattatcccaaatattttcccacatttctgtatctctctcaaggctgcatttaaaacatgttgggtaatattccattcatttgataaatcataaatggtaattttctaagcaattcctctacttttggatatttagttgattttaagattttgttawtacaggtaatactttcatagatattatgtgtatcaccttttcttctcgtgtgtttttttcttaaggtgtattcttacgagtgggattcatgggtttaaagagtttggtttctgacttgtgatatgggtcaaggcaaatgttttccaaaccactgacagggctgtgaggcaagaacgaaagggcagatctttgatctccacacggaagctcagcatgtttatttgaattcagtaaccagtggtcctaaccagatcagtgaatgcttgacagggtccttccatcacacagctgggaccttcc

SEQ ID NO: 205603 - DNA, 601 bp, Human
ttcttacgagtgggattcatgggtttaaagagtttggtttctgacttgtgatatgggtcaaggcaaatgttttccaaaccactgacagggctgtgaggcaagaacgaaagggcagatctttgatctccacacggaagctcagcatgtttatttgaattcagtaaccagtggtcctaaccagatcagtgaatgcttgacagggtccttccatcacacagctgggaccttccatcacacatctgctaattgtgccagttagtggctacagacctctataaggccactgagcccaccaccttgmcctcagaaccctgggctgggttctcccttttcccaggctttttgcttgtaggaatgccacaatgactttacaaccagtggaagccccagaagggaactgatggaatccctaagggctacaggcagcttcccatgggtttggatgggtgctcaagatcttccgtgacctagtctcggtctaagagatttacttgccattgcttctcaaaatagcacctccactgcaccaagacagattgttctctggcccgggaagatgactcctggccctcactgaagttgctctctcacccttgccttt

SEQ ID NO: 205604 - DNA, 601 bp, Human
ccttcggactccaggagtggcagcgccttctggcagcacatctgacttcccacccagctctcctgctacaattacctgcactcctgcagaaccctccgtccacatggcaggacttagcacataattatatgccttctttaatgtttgtttttgcagttgttatttcttgaagataactgtactctcctcgagggcaggaactgtgtcatccttccctagacccctccaagcgtggcttcagtgctgagccctttgcctgaacccagccaatccagtgtgacccattacatcaaagcgtctstgccgatgatgcagtgtgaagcgtcttagctatccttttcttttgtgttttccacataagtgctcctattcaaaacctgctgaggatattatttagaaaatgctcatagatggggaatactcatattgtctattgatcacagtttgggggttgtaagatcaagttaatgctggaaaacaataacctggtcacttgttacttccgagtcctcagtgtttactagggtgggaagggtgactggttaggaggacctgggtggggggataaggagctgtaggaggcactggaatatctctctgg

SEQ ID NO: 205605 - DNA, 601 bp, Human
tattgggaaatagtaaatgacactaacctattattagtgggtttccctctgttgtgatattgaagtaaaacttctttcttgaagggcagattcagtaccagatgggctgatgacattgtttgactacagaattcgaaataacagggaatgaggctctgtggcaagtctttcttttcttttctttctattttttattttattttattttattttgcagtggggggttgcagtggaaagatttggtttatagcggcttcctcaacattcttccccaaggccctcattgtttcactttcagcgrgcaacttcccctctctaagcctccgcttttcgatgaggaggctgacaggtgaactctaaggcctctgcagctctaggcccttggcctttacctcttacgccttcaggactgaaagctcttggagcagggggcagcccctgggaggcccactgtgcatggccagcatgtgtggttttagaagagatgaatcatgtgcataatttctacaagttaacaacatataagaagcagaattctacagatgataaagtagaatatgtttgacatctaagaattcttactttagaagtgcagtttagc

SEQ ID NO: 205606 - DNA, 601 bp, Human
ctttagaatgctaccgaaataagaactttgaaatgtaatccactctacagatgaccattgaacttccatgaagcttttagattagaatgtgaaatgtcaggaaagacagatagagtgtgggataaaggcattccagtgtgaaaaatgcatgaatggtcatatcaagggatcagagaatagatagatgattccttaaaaactgtcgctggcatacagtcttcacagattttcttatgtagcccaacagttagtttttctcctggtctccttttctctctggtttttctgcccccatcattcytagcttcctctgtggctctccctctcctctgcccttttggacaatgagaacgaaggtaataggcttggtcctcctggggggcttctcctacctgtgtgtgatgctgtctttcaagtcagtgggagccctctgcttgcaagctggaaaagtggagccacacattttgcaattacttcctgtctttgttcctggtagctgtgagtgcccccttggctctcacccatttgatctttagagcgcccgccctgtgtagtgggcatcattgtgctcctttataggcagacaaactgaggcacccag

SEQ ID NO: 205607 - DNA, 601 bp, Human
cccagagattaaagaaacatggccgaggcttcctcaggtatgagaacatcttttgccaccctgctgggcctgtcttagaaaggttctctctggccgtcaatatcttaatgaaagtgacattccgttggccacggtccactctgtccacgtggagggccgggttccagcctctgcagaagtgcttgttctcagcacagaccagctactcattgccttaaaaatactccatagtcaagaagatgggtaatttcacgagaaaatcaaagcttactaatttaaaagggtggaaaatggagggcakgggattccaagcttaatttgtgaagattcttggtacaattaaaaaatattttatataaaatattagctgggtatggtggcatgcacctctaatcctagctacttgggaggctgaggcaggagaattacttgaacccaggaggcggaggttgcagtgagccgagatcgcgccactgcactccagcctaggtaacagagcgagactctgtctaaaaaaaaaaaaaatttaaactttactatctttgaacataaatttgtcatccaaactaggatacattcgagagtaaaaagagtgctgtga

SEQ ID NO: 205608 - DNA, 601 bp, Human
aattatactgaaataatgaaataatgagggataaacctggagggttttaggcaattaggatataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagyttgaaagttaatgcgtattcataaaacctagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcaattactgagaattgactttgttttggaacactgaaacatttaaaaaaacattctgctaagtcaaaattctttgaacccat

SEQ ID NO: 205609 - DNA, 601 bp, Human
ggataaacctggagggttttaggcaattaggatataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagtttgaaagttaatgcgtattcataaaacstagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcaattactgagaattgactttgttttggaacactgaaacatttaaaaaaacattctgctaagtcaaaattctttgaacccatcattatttattttttaatttaaaagttt

SEQ ID NO: 205610 - DNA, 601 bp, Human
tataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagtttgaaagttaatgcgtattcataaaacctagtttgtgatacttcaataagagtgagggarttgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcaattactgagaattgactttgttttggaacactgaaacatttaaaaaaacattctgctaagtcaaaattctttgaacccatcattatttattttttaatttaaaagttttgtgggtacatagtaggtatatatatttatgg

SEQ ID NO: 205611 - DNA, 601 bp, Human
cacatccacactagtagttacgctaactttggaaattatattcaataaatattgttgtgttcttcctgaataacttcagtttgaaagttaatgcgtattcataaaacctagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcarttactgagaattgactttgttttggaacactgaaacatttaaaaaaacattctgctaagtcaaaattctttgaacccatcattatttattttttaatttaaaagttttgtgggtacatagtaggtatatatatttatggggcatgtgagatgttttgatataggcatgcagtatgtaataatcacatcatggaaatggggtgtctgtcccctcaaacatttatcctttatgttacaaacaatccaattatactcttagttatttttaaatatacaattaaattactactaactatagtca

SEQ ID NO: 205612 - DNA, 601 bp, Human
cattcttctgtggatggacacttaggttgcttccaaatcttggttgttgtgaataactgctgcagcaaacctgggagtgcagaggtctcttcgatacactgatttcctctcttttgggtacatactcagcagtgggattgctggatctgaaggtgtgaacccgtaccatttgggaactcacgtccaggctttttggtgaaaggtaagattctgcagtgagaaaccttaatgttgataaattgataccaagcagcaacagcagaagtacctctgcaaattctttgggttgtcgtgagttttyaggctcctagtagcctgatggcaatgtctctctgacctcaaaccactggaaaacatgttttccgggtcagattctctgaagattcttcaaacaagagtggggagcaaaagccaagccgaggacttaggaaaatgtgttttttgtcgcacggcacatctcttttgacagctaaggtgccgagtgttcgcgtgacctttttttgaacagctgtgtgaatggacaggtcccggagcaggggcccgtggctgacaggagcccagagacttgtccctctctggggtactcaccttcggcccctcc

SEQ ID NO: 205613 - DNA, 601 bp, Human
atacactgatttcctctcttttgggtacatactcagcagtgggattgctggatctgaaggtgtgaacccgtaccatttgggaactcacgtccaggctttttggtgaaaggtaagattctgcagtgagaaaccttaatgttgataaattgataccaagcagcaacagcagaagtacctctgcaaattctttgggttgtcgtgagtttttaggctcctagtagcctgatggcaatgtctctctgacctcaaaccactggaaaacatgttttccgggtcagattctctgaagattcttcaaacragagtggggagcaaaagccaagccgaggacttaggaaaatgtgttttttgtcgcacggcacatctcttttgacagctaaggtgccgagtgttcgcgtgacctttttttgaacagctgtgtgaatggacaggtcccggagcaggggcccgtggctgacaggagcccagagacttgtccctctctggggtactcaccttcggcccctccaaggagagtgagatcaatgtaagatgaaccaatcacaagaaatcgtttcctgtctgacatgaatgggaggtgagttttgaatcagccccggtt

SEQ ID NO: 205614 - DNA, 601 bp, Human
gacaggagcccagagacttgtccctctctggggtactcaccttcggcccctccaaggagagtgagatcaatgtaagatgaaccaatcacaagaaatcgtttcctgtctgacatgaatgggaggtgagttttgaatcagccccggttatttgtctgccagccaagaaaacaacattggaagcagccggcaatatgtcagacttcaaagggaagtgtcttggtgtctcactggcacatatccagcatgatgttggtaaataaccgagtcccggtgtggcgtatttctccctgaatcttgactcaaaactactgaagcccattctgtgaactctggaggggcagccactcattccaggaaaaaggccagaaagaatgacattgaaatgtgtttataattagcgaaacaatctaaattcacaagatggtcagaactgcaggctgctaactggtgcaaacttcttaaatggtagagcacttggagagataaaaataggccttcctccctgggtaatttgaagcaacttgagggggcaatggtcattggagacatagtttaagatgcattttattttatatatcttgtgcatgatttcaactttcgt

SEQ ID NO: 205615 - DNA, 601 bp, Human
gcgtatttctccctgaatcttgactgaaaactactgaagcccattctgtgaactctggaggggcagccactcattccaggaaaaaggccagaaagaatgacattgaaatgtgtttataattagcgaaacaatctaaattcacaagatggtcagaactgcaggctgctaactggtgcaaacttcttaaatggtagagcacttggagagataaaaataggccttcctccctgggtaatttgaagcaacttgagggggcaatggtcattggagacatagtttaagatgcattttattttatatrtcttgtgcatgatttcaactttcgttttcttcttgagtgtagagaagtcagataatatagagaaggagaaagagacctttgaaaacctgtgttgaaaatctcttttggtttggaaagcattggctgggatggtgcagccacgttgacctgggctggtccagaaaagaacaaattatggagtcacagaggagggtgggttcatatgtttagagtatggaaggtggactgtaggttggaggatggcacagaatccattgtagaggggagtaagttagagaatgtttcatataataacacttt

SEQ ID NO: 205616 - DNA, 601 bp, Human
aaatagtttcttttcatctgtaagttcacccttctttctctctttcccttgctatttatttaagaaattaaataattcagcctgtcctatttcctttagtcttgaccgaacgatcatgttcatttgtcctcttgtattttctacaaaccgagagtgagagggctgatcagcatctgtaagtggtggtgtgtttcattcaggaggcatttaacacccggttccttttctatttatttatttatttatttatttatttatttatttatttatttattttgagaaagagtctcactctgttgcygaggctggagtgtagtggtgcggtcttggctcactgcaacctctgcgtcccaggttcaagcgattcttttcctcagcctcctgagtagctgggattataggcgtgcaccaccacacctagccaatttttgtatttttagtagggatggggtttcaccatgttgccaggctggtgtctaactcctgaactcaggcgatccacccgtctcagcctcccaaaatgctgggattacaggtgtgagccactgcgcccggccctggttccttttcttttggtgaagttagcatccccttactgatc

SEQ ID NO: 205617 - DNA, 601 bp, Human
aaaaaaaaaaaagatatttgttaggtccagtacaatgtacacctttttggtttttttttgtttgtttgttttttgttttcccctggtaggcaatcaaaatcaaacagtgccagttcttttttttcaggaataactggaaatgttaccactgaaagcctaagaagtgggattcagttgaagcaacatggttgaaccatgtggagaaacagacgtttagcttggcataccttaggcccaagtagtgtgaacagtgatgcaagaacctgtgaactttccctacattcttatgtacagagtcttraaagcccacgatcattgtattattctatgtccataaccactaggtgttattaggaaaaacacttttcatcttcctgggtcatcagtgtcccagacttacacaaagaattatatttgaccaagaccaagtttccttgctgagctcactgaccttgggagcaacagtggtgcctgcagatggatgtctttctgatggaggtcccaccctatatccttccagatttcagctgggattccaacattcatgataatatggaaataatcagtgatacatcatggtagacattaccatgaagaaact

SEQ ID NO: 205618 - DNA, 601 bp, Human
gcaacatggttgaaccatgtggagaaacagacgtttagcttggcataccttaggcccaagtagtgtgaacagtgatgcaagaacctgtgaactttccctacattcttatgtacagagtcttaaaagcccacgatcattgtattattctatgtccataaccactaggtgttattaggaaaaacacttttcatcttcctgggtcatcagtgtcccagacttacacaaagaattatatttgaccaagaccaagtttccttgctgagctcactgaccttgggagcaacagtggtgcctgcagatrgatgtctttctgatggaggtcccaccctatatccttccagatttcagctgggattccaacattcatgataatatggaaataatcagtgatacatcatggtagacattaccatgaagaaactcaaaacaatctttcaaaaatatgcttagcataagctgagtgaacacatagtcagatgtggccttccagaaccaagcctactcagggtgaatcagcactgtgttttcttaggaaaagaaattttattttatttttttgccatatgcctgttgtctcctaaaaagtcctttgaatctcatt

SEQ ID NO: 205619 - DNA, 601 bp, Human
gcaacagtggtgcctgcagatggatgtctttctgatggaggtcccaccctatatccttccagatttcagctgggattccaacattcatgataatatggaaataatcagtgatacatcatggtagacattaccatgaagaaactcaaaacaatctttcaaaaatatgcttagcataagctgagtgaacacatagtcagatgtggccttccagaaccaagcctactcagggtgaatcagcactgtgttttcttaggaaaagaaattttattttatttttttgccatatgcctgttgtctcctwaaaagtcctttgaatctcattcatgtttttatgtgatgacccttttccagtttcctaatttccataattctgccacttgtcaggtcacgatggagctgtttctagtgggagcctgcgtccatctttcttccagcacccttatatggattcagtgcttggtgacattcttattaccctttctttcaccagcattctgtttcctcagcatatgacctttatcagggtggcagtgggcactcacattgggaagcatggaagagttttgattcatcttacaaggacattaagggaggaggactg

SEQ ID NO: 205620 - DNA, 601 bp, Human
cctactcagggtgaatcagcactgtgttttcttaggaaaagaaattttattttatttttttgccatatgcctgttgtctcctaaaaagtcctttgaatctcattcatgtttttatgtgatgacccttttccagtttcctaatttccataattctgccacttgtcaggtcacgatggagctgtttctagtgggagcctgcgtccatctttcttccagcacccttatatggattcagtgcttggtgacattcttattaccctttctttcaccagcattctgtttcctcagcatatgacctttrtcagggtggcagtgggcactcacattgggaagcatggaagagttttgattcatcttacaaggacattaagggaggaggactggggagggtcgtctggggaatttcaggaatgtgatgacactaggagcaggaagtgacagctacctgaggacagatgagcccagaaaccctttcccgttccttgctcttggctgaataacttgtgcctggcgggtgtgtctttggccaggcctcacactgacagctctgcagtacagatatgcagtgggatggccacatgatggggaaagcccaatagca

SEQ ID NO: 205621 - DNA, 601 bp, Human
cctttcccgttccttgctcttggctgaataacttgtgcctggcgggtgtgtctttggccaggcctcacactgacagctctgcagtacagatatgcagtgggatggccacatgatggggaaagcccaatagcatggagtctgtgtggggctctgctttcccacgtgcagaaaatgagagccgccttcccgagcaaatagccagtgcatgcttttatcctgctgccaagacataggtctgcagtgatgcataagaaatgaccagacatctgcaccaactgaatgacaaacagcttttcaattrctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcac

SEQ ID NO: 205622 - DNA, 601 bp, Human
cagtacagatatgcagtgggatggccacatgatggggaaagcccaatagcatggagtctgtgtggggctctgctttcccacgtgcagaaaatgagagccgccttcccgagcaaatagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcartgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatact

SEQ ID NO: 205623 - DNA, 601 bp, Human
aatagcatggagtctgtgtggggctctgctttcccacgtgcagaaaatgagagccgccttcccgagcaaatagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttmcatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatat

SEQ ID NO: 205624 - DNA, 601 bp, Human
aaatagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctag

SEQ ID NO: 205625 - DNA, 601 bp, Human
tagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctaggct

SEQ ID NO: 205626 - DNA, 601 bp, Human
ccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctaggctagg

SEQ ID NO: 205627 - DNA, 601 bp, Human
cttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctaggctaggttgagggrttgtaatttaaaataacatagtcagagaagtcatgaaggaaaaatacctgagacaggttgttttgcacagatttatggaaaaagtgtcccaggcagaaggaatgcaagtacaaaggccctgaggcaggagtggcggaggcctgtgtggctggcgtgtaatcagcaagggaggaggaggagcagctgaggtcagagactacgagatcatgaagggcaattcacaggtaattcgtgggtaattgtggggactttaacatttattttgcacactataggaagtctagagggtttaaggcagag

SEQ ID NO: 205628 - DNA, 601 bp, Human
gagaagtcatgaaggaaaaatacctgagacaggttgttttgcacagatttatggaaaaagtgtcccaggcagaaggaatgcaagtacaaaggccctgaggcaggagtggcggaggcctgtgtggctggcgtgtaatcagcaagggaggaggaggagcagctgaggtcagagactacgagatcatgaagggcaattcacaggtaattcgtgggtaattgtggggactttaacatttattttgcacactataggaagtctagagggtttaaggcagaggtatgacgtgacttttttttttttwaagccaccgtgagtgctctgttgaagatggcatgtttaggttggtgagagatgcagcaggaataccacttaggaagctattgcctcctagttcaatacttttggcttttgaacgtaactacttttaataataatacaaaaaaagctttaggcctttatagaccttctcaaatgccatattttcatagttttgtaaggttttctatccctctgttttgagaatttaaatagcccttttaaatgacacattagcttggctattatcaaaaattcaaaagatggcaagtgttggtgaggactc

SEQ ID NO: 205629 - DNA, 601 bp, Human
tgttttgcacagatttatggaaaaagtgtcccaggcagaaggaatgcaagtacaaaggccctgaggcaggagtggcggaggcctgtgtggctggcgtgtaatcagcaagggaggaggaggagcagctgaggtcagagactacgagatcatgaagggcaattcacaggtaattcgtgggtaattgtggggactttaacatttattttgcacactataggaagtctagagggtttaaggcagaggtatgacgtgacttttttttttttaaagccaccgtgagtgctctgttgaagatggcatrtttaggttggtgagagatgcagcaggaataccacttaggaagctattgcctcctagttcaatacttttggcttttgaacgtaactacttttaataataatacaaaaaaagctttaggcctttatagaccttctcaaatgccatattttcatagttttgtaaggttttctatccctctgttttgagaatttaaatagcccttttaaatgacacattagcttggctattatcaaaaattcaaaagatggcaagtgttggtgaggactctcactgttggtgggattgtaaattggtacagcca

SEQ ID NO: 205630 - DNA, 601 bp, Human
catttttagatagaatggtttgatttaaaccactcagaatcatgttgaaagtgtgcattggatctcatacaaaatgggtcacttcatgagagttgaagttgagaagcacttcagattgtacttctggtatacttggaatggagcacagggcaaaggaacattgtaatgtgatttagaatatgaaatcagtgcttgaaataagactataatgtatcgatgaagtacatcagcatttgcgtctatctcttaactcttttacctccacagaccactgggatagaatgtcagatattggttatcrgccaaatttgggcttcagtcagtgaatttgaagacaggtcagtagaaattctccaaactgtagcacatagagaaaaactattgttatggaatgaacagatcgtcagtgattgggagagaatggcaggtggtgtaatgtatgtgcaattggagtgtcaccagaagcccagacagatactgggacagaaaatgtatttgaggaaataatgaccataaatttgatgaaaaattgtaggggtgtagttaagatgaatgccaaatctagatggttaaaggcaggggtcaaatcaagaccatggta

SEQ ID NO: 205631 - DNA, 601 bp, Human
ccttttagaacaaatgggttttggtgacagtgtgttcagatggaatactcacagacttggactcacacctgggttcaaatcccagctctacctaatctaactagttctgggtccatggcaaatcactatagtctgcatcctaggatcatcatttgttcaatggagatagtgatatctctttggcaaggcaggtctaaatggtgtagaatatgtacgttttatagggtggtgatgcgcacatcatagctaggcccttaacagatagtagcttcttctcccaccaaaccagttctttttgtgkttatctggtgtcaccgttcacccacttagctataaaccagattaagaaaattacactttttacaaagggcgtgaagaactatggaaatgataggatcatctttgcatgttagaatgattgctccagcctgagtgtgaagaatggcatgagggtgtgagacaagatttgaagaaaccagattgaagtctctcgctacagcccacacacctcttcatacccttcccaaacaaacaacagtattctcctttttcacaaaagagcttgattttcctatttaaaccacagcctcaactattacca

SEQ ID NO: 205632 - DNA, 601 bp, Human
acacctcttcatacccttcccaaacaaacaacagtattctcctttttcacaaaagagcttgattttcctatttaaaccacagcctcaactattaccagaagaaaaaaaaaagaccaaataaaaattatctgggtccccttttctcaagagcagagagggcacactctttaatgggttagagatgggggctggaccaggtggtagtcttgtgtatggagtccagtggacagagctgagagtccctctactgacagtccctggattcatcaccaccacatttctaagaaatctgattattacytccccatcagagagagacactcctcgtggtacagctgtgatcatatcattcctttgctggggaaatcttggtcactagaaagattcctgcactccttagtctgacatgtaaggttctgcagaacctaatttcaatctactctcctagccttttttaaatgaacactactactagggccgggcgcagtgggctcacacctgtaatgccagtactttgggaggatcacctgaggtcaggagttcaagaccagcctggccagcatggcaaaacccatctctactataaatacaaaaataagct

SEQ ID NO: 205633 - DNA, 601 bp, Human
ctaatttcaatctactctcctagccttttttaaatgaacactactactagggccgggcgcagtgggctcacacctgtaatgccagtactttgggaggatcacctgaggtcaggagttcaagaccagcctggccagcatggcaaaacccatctctactataaatacaaaaataagctggccgtggtggcgcatgcctgtaatcccagctactccagaggctgagggagtagaatcgcttgaacccagaggcagaggttgcaatgagccgagatcgcatcactgcactccaacctgggtgacrgagtgagactccatctcaagaataaataaataaatacatgcatacaacttctcacccaacctgtgttgaggccttgtcatctcatcccttactctaaccactgcacaccctcccatatattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtctt

SEQ ID NO: 205634 - DNA, 601 bp, Human
caagaccagcctggccagcatggcaaaacccatctctactataaatacaaaaataagctggccgtggtggcgcatgcctgtaatcccagctactccagaggctgagggagtagaatcgcttgaacccagaggcagaggttgcaatgagccgagatcgcatcactgcactccaacctgggtgacggagtgagactccatctcaagaataaataaataaatacatgcatacaacttctcacccaacctgtgttgaggccttgtcatctcatcccttactctaaccactgcacaccctcccatrtattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtcttggattacttggggcctagtctcaaatataagccctgaatataaatacttgttagatgaatcacgttctttacattgtcgatagaagtgggaaaaattctttttattcatttatttaa

SEQ ID NO: 205635 - DNA, 601 bp, Human
ctcccatatattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtcttggattacttggggcctagtctcaaatataagccctgaatataaatacttgttagatgaatcacgttctttacattgtcgatagaagtgggaaaaattctttttattcatwtatttaatttgcccagagttgcggaagaactaattttaaaagtttaggtttgaatagaggagcaaaaagtcatagagagggacttaaagaggaagtctcaagggaacttctgaaaacttctttgggctttagctgttgatgggccgatgttctttatggtgccagctctcgttttgatgtagatgtctgacgagcctagttttctgggtactcgttggatgagtgacactcggagcctcagagaggagggatgcagggtgcaggtgctaggtgaagggaactagtgtttactgaccatct

SEQ ID NO: 205636 - DNA, 601 bp, Human
tcccatatattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtcttggattacttggggcctagtctcaaatataagccctgaatataaatacttgttagatgaatcacgttctttacattgtcgatagaagtgggaaaaattctttttattcattwatttaatttgcccagagttgcggaagaactaattttaaaagtttaggtttgaatagaggagcaaaaagtcatagagagggacttaaagaggaagtctcaagggaacttctgaaaacttctttgggctttagctgttgatgggccgatgttctttatggtgccagctctcgttttgatgtagatgtctgacgagcctagttttctgggtactcgttggatgagtgacactcggagcctcagagaggagggatgcagggtgcaggtgctaggtgaagggaactagtgtttactgaccatcta

SEQ ID NO: 205637 - DNA, 601 bp, Human
gatgtagatgtctgacgagcctagttttctgggtactcgttggatgagtgacactcggagcctcagagaggagggatgcagggtgcaggtgctaggtgaagggaactagtgtttactgaccatctaccgggtgccaagccatgctgaaaggcagagatttccaagggaggaaaatggttgggagataggaaagtgacagaggaagtattctatccatgccagaaagacgtaaggtgtaaatgactgtgtggcatgccataggaaaaaatgggaagtgtgaaattcctcagattcactgcamagtaacttggggaagagctcatgatgctagtcaagttatttcttagcctctggacctcatggttcctgttatgagatttggctaagctagtggcagggaaccacggcttctagtgttttcttcaccccatttctacagcaggtgactgttcaggtgactataggggaggggtcacatgtgatgaaaacactgagtatctcaaaccagctgtcttgcctaggcctcagttttgaatgtggtagatgaaaggtttaactttccactaatagccctcccagctctgctgttccttctgggatg

SEQ ID NO: 205638 - DNA, 601 bp, Human
tgtctgacgagcctagttttctgggtactcgttggatgagtgacactcggagcctcagagaggagggatgcagggtgcaggtgctaggtgaagggaactagtgtttactgaccatctaccgggtgccaagccatgctgaaaggcagagatttccaagggaggaaaatggttgggagataggaaagtgacagaggaagtattctatccatgccagaaagacgtaaggtgtaaatgactgtgtggcatgccataggaaaaaatgggaagtgtgaaattcctcagattcactgcacagtaactkggggaagagctcatgatgctagtcaagttatttcttagcctctggacctcatggttcctgttatgagatttggctaagctagtggcagggaaccacggcttctagtgttttcttcaccccatttctacagcaggtgactgttcaggtgactataggggaggggtcacatgtgatgaaaacactgagtatctcaaaccagctgtcttgcctaggcctcagttttgaatgtggtagatgaaaggtttaactttccactaatagccctcccagctctgctgttccttctgggatgaaatggag

SEQ ID NO: 205639 - DNA, 601 bp, Human
ttgcagaaaccttagaaaagtcagtgcccatgaacagacacatttaggaaatagaaaattactaaaggatgcctcttcggcaaactgggtgccatatgtgtgcatatatgagtatatatatatgtttgtttgtttgtttgtttgtttgttttttgtttttgttaaggctttctttactttgccccaggccagctggtgtgcatatttgtcaggtcctgttagagctctacagctcattctcagcctgcctgatctcagccttgctctcaggtcctcaggaggagtttgattcttttggacygtggtgctactggctatttaatcctttatcgtcaccatgtccagctagcaaccacttgccttccagcagctgggagaactgtgctggtccagggagctggttttgagaagcctgggcttccacgagcagaggtcattctgtctagagatccatggctcaccagtccatccctggggagcagctgtggctccactgtccttcagagatacagacacagtgaggcacattctgaggagagcagatagtgagtagatcctaaaatgtgttgaatgaggagcagatgaaggagcttggattctg

SEQ ID NO: 205640 - DNA, 601 bp, Human
tgactgaacacttgtttgctgtaatatgaaaggggttatgaagatttccagggcattgaggctagatgagaaggaaggtcccttccaaccttggaattctgattcttgacccctcttggtaaatacatacctggtactcttcagagaatattcccggggttaaggctgaaaaatagcaatgtgtataaagaacctggagctgcattaatcacagtgcagaggtacagtggagtgtacacgtgcatatgagcacattttaaattagggaaggggctgaaaagaaaaattaatcaaattaaarcagcattaggaatgatgtggacagaaggtaattagttgccatcaaatactgaaaatatcaatcaaccgctaattgctatatggtttcttttattagcagaaggtattttcaaattttgtagatttcaatcaagagtagggataaggaaggtgtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctccc

SEQ ID NO: 205641 - DNA, 601 bp, Human
gactgaacacttgtttgctgtaatatgaaaggggttatgaagatttccagggcattgaggctagatgagaaggaaggtcccttccaaccttggaattctgattcttgacccctcttggtaaatacatacctggtactcttcagagaatattcccggggttaaggctgaaaaatagcaatgtgtataaagaacctggagctgcattaatcacagtgcagaggtacagtggagtgtacacgtgcatatgagcacattttaaattagggaaggggctgaaaagaaaaattaatcaaattaaagyagcattaggaatgatgtggacagaaggtaattagttgccatcaaatactgaaaatatcaatcaaccgctaattgctatatggtttcttttattagcagaaggtattttcaaattttgtagatttcaatcaagagtagggataaggaaggtgtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctcccc

SEQ ID NO: 205642 - DNA, 601 bp, Human
acctggtactcttcagagaatattcccggggttaaggctgaaaaatagcaatgtgtataaagaacctggagctgcattaatcacagtgcagaggtacagtggagtgtacacgtgcatatgagcacattttaaattagggaaggggctgaaaagaaaaattaatcaaattaaagcagcattaggaatgatgtggacagaaggtaattagttgccatcaaatactgaaaatatcaatcaaccgctaattgctatatggtttcttttattagcagaaggtattttcaaattttgtagatttcartcaagagtagggataaggaaggtgtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctcccctgctctcttctttgctggatagctgaccagaagagacttactccaggccaccaagatggtgtctgggaatgtgtgtccgtggccagggtctggctgtctctcgtccactgagctacctttctagagt

SEQ ID NO: 205643 - DNA, 601 bp, Human
gtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctcccctgctctcttctttgctggatagctgaccagaagagacttactccaggccaccaagatggtgtctgggaatgtgtgtccgtggccagggtctggctgtctctcgtccactgagctacctttctagagttgagctcaggatatttctggtctstgcctatgttccaccttctgatcaaggacctacagctatccagctgtagccggaattgagggtccttttgttgccctggtcagaggtttcatcaaggtgcgcccttttgcctttgaagaggccagggagccgtggagaggagcaccttggaaatgcgctgcatgtggtttgctgtttctgtgcccctgactctacgtgtactttattgatatccagtaaatgcccagtacagaaaatgcacctctaatagggtgctccataaaattatgctcccttcccgagatccacgtgaactgcatg

SEQ ID NO: 205644 - DNA, 601 bp, Human
gggaaaattttatttactcactgatcacaattgtaatgtcacagttaaagttgaggagaagaaaaaaagacgaaaaaagatcttgattctctttatcatttccttccacagagccatcagatcattctatgaccaagtgagatgttataaataatttagttctactcattttttacatgacagattaaggcttcagacatcctgctgtgtgactcagagacacacactcacctgcccttggttgagactaggtgtctttgcaggttttgggtgacaaagacctggctggtgatactgagccaggagatggtgagaaggtcaatatatgaagacgcattaagcttttgcaaagctgtgggttcagaagtagccattagagagggatcatctgagttgggtgataaccaaagagttttatgcttgagaaatggagaaactggctcaggaattctgtaggcagcgtccagagaggctgctatgaggctgcagtatggtacgtttcatctgaggactgggggccggctctgaggctgtaccacagcatgctgtgattctcagagatcagggtgaccagaggagcagctctgacctcgagtggact

SEQ ID NO: 205645 - DNA, 601 bp, Human
catcctgctgtgtgactcagagacacacactcacctgcccttggttgagactaggtgtctttgcaggttttgggtgacaaagacctggctggtgatactgagccaggagatggtgagaaggtcaatatatgaagacgcattaagcttttgcaaagctgtgggttcagaagtagccattagagagggatcatctgagttgggtgataaccaaagagttttatgcttgagaaatggagaaactggctcaggaattctgtaggcagcgtccagagaggctgctatgaggctgcagtatggtacrtttcatctgaggactgggggccggctctgaggctgtaccacagcatgctgtgattctcagagatcagggtgaccagaggagcagctctgacctcgagtggactgagaggggatttagagggtgtgcctgcgcatgtggggagggcagaggtggtgcaggcagggagcctaagagaacagagtggacacgaacgcttactgagtacctcatagatgaaatcccctcagtgactgtgaataatattctctttactcctagtttatagatgagaaaaaaaagggttagagagtacagagaatt

SEQ ID NO: 205646 - DNA, 601 bp, Human
ttttgtgggttataaaagtaatgcatgctcattacagaaaatatggaaaatatatgaaaatacaaaagaaaaccagaggcaaccattattccaatattttattgtattttcttccagactatctgtcagtctgtataaacatttttgaaaaacttcttttgacagttggaatacatacttcttatagaaatttggaataaactgaagagcaaaaagaagaacataaaaatcacctgtaatcttagtcagtaagattcttaagactgtttaagattcttgcatcttacctatttgtgggttwgttgttgtggtggttttaattgagatggagttttgctctcgttgcccaggctggagtataatggcgtgattttggctcactgcaacctccgcctcccaggttcaagcatttctcctgcctcagcctcccaagtagctgggattaccagtatgtgccaccacgcctggctaatttttgtatttttagtagagatagggtttcaccgtgttggccaggcgagtctcgaactcttgacctcaggtgattccccccaccttggcctcccaaagtgctgggattacaggcatcagccaccgcacc

SEQ ID NO: 205647 - DNA, 601 bp, Human
aattgttgtgtacgtggctgtgttctgagtgaagtctaaaagcaggggaaagagctggaagagagggagcatttggataagacactgaaggaacatgcggtaactgcacatgttctaatgggagcccagcctccctgttggtttccactctgacaagacagactgctcttcctaccccatctgttgttggagggtttgttattcagtggtacccttagtaggcagaggtggagagtggggcattctagttaacaggagtgtgctagttagcaagagaatggagtgtactagttagtagaayttgccctagccaatttatgtagtgaacccataggacatgtcagatctggaaaactgcctttcatgagtgcggaagatgtagtggtcggcctcttaggtatttttagagaatcacatttgaacaatcacaatcacagatctttaccagtcaggtcaaaatttggagtgtcaatgtgtttggaaaagggctttatgaaaatttgaactttctttaaagttcttcctgaagatttcatatgagaacccaaatcttaagggaaactaaaatctcataataaaaaatctcatagacacagatatt

SEQ ID NO: 205648 - DNA, 601 bp, Human
tgctcttcctaccccatctgttgttggagggtttgttattcagtggtacccttagtaggcagaggtggagagtggggcattctagttaacaggagtgtgctagttagcaagagaatggagtgtactagttagtagaacttgccctagccaatttatgtagtgaacccataggacatgtcagatctggaaaactgcctttcatgagtgcggaagatgtagtggtcggcctcttaggtatttttagagaatcacatttgaacaatcacaatcacagatctttaccagtcaggtcaaaatttgsagtgtcaatgtgtttggaaaagggctttatgaaaatttgaactttctttaaagttcttcctgaagatttcatatgagaacccaaatcttaagggaaactaaaatctcataataaaaaatctcatagacacagatattcatgagtaatgacagattaaaattgtgagtagaaatgcaggaatcttaaggtaattctaaataaaaacaatccagtaggactattggaaaattcttaccaagtaatgattttgtaatgattgtgtcaaaaatgtaaatttgattcagtgacacagttgtaatt

SEQ ID NO: 205649 - DNA, 601 bp, Human
tagtaggcagaggtggagagtggggcattctagttaacaggagtgtgctagttagcaagagaatggagtgtactagttagtagaacttgccctagccaatttatgtagtgaacccataggacatgtcagatctggaaaactgcctttcatgagtgcggaagatgtagtggtcggcctcttaggtatttttagagaatcacatttgaacaatcacaatcacagatctttaccagtcaggtcaaaatttggagtgtcaatgtgtttggaaaagggctttatgaaaatttgaactttctttaargttcttcctgaagatttcatatgagaacccaaatcttaagggaaactaaaatctcataataaaaaatctcatagacacagatattcatgagtaatgacagattaaaattgtgagtagaaatgcaggaatcttaaggtaattctaaataaaaacaatccagtaggactattggaaaattcttaccaagtaatgattttgtaatgattgtgtcaaaaatgtaaatttgattcagtgacacagttgtaattttgatatgttctttaagtctcttaggtgcttaagtcatgatgtaagtttgaa

SEQ ID NO: 205650 - DNA, 601 bp, Human
agtgacacagttgtaattttgatatgttctttaagtctcttaggtgcttaagtcatgatgtaagtttgaatatttttttccttcaatttaaaactttatttctacggaatgtagatgtccttcagaagttcctaggggaggtggtggtggtgacaggtaaattcattgtgtctatgacttccaaaggccagttttcagaccactgtcatcagtatcaccttaggttaaatattttgtaaggaacaattcagatatatcccggaagaggtaccttttatgctttagtccaggccctctgggktttacctgtttcttgttgtagccactgctgcagcagggaaccctggaaactctaatcaccttcgtgtaggtacaacttgaaagtgcttctctcttcttgccttctgcccaaggtgacacacccatgtgtgtgcaactgtgaaaatgagcctgcaaactcaaattctaaagaatatgaataatgcaaagaaaggaggcaacaatatgaagaaatgaaatataaattgactcgagttaattttttataacaaacaaaagcattttaaaatgtgtgtttaggatgttcaaagaggtcagtgaa

SEQ ID NO: 205651 - DNA, 601 bp, Human
aggccagttttcagaccactgtcatcagtatcaccttaggttaaatattttgtaaggaacaattcagatatatcccggaagaggtaccttttatgctttagtccaggccctctgggttttacctgtttcttgttgtagccactgctgcagcagggaaccctggaaactctaatcaccttcgtgtaggtacaacttgaaagtgcttctctcttcttgccttctgcccaaggtgacacacccatgtgtgtgcaactgtgaaaatgagcctgcaaactcaaattctaaagaatatgaataatgsaaagaaaggaggcaacaatatgaagaaatgaaatataaattgactcgagttaattttttataacaaacaaaagcattttaaaatgtgtgtttaggatgttcaaagaggtcagtgaagaaataataaactatgacagaaaataggcaaaataaaagaactaaatataaaacttggaataaaaaatagctactgaaataattccatacctggaactcttagattgaacccagttgatgaggaacttagttaatgttttagtgaatagttctgatgcacatagagcaggaaaaagaagaatgt

SEQ ID NO: 205652 - DNA, 601 bp, Human
agagagaaaatgagggaaaagaaattaaaggaagaggatggtaagtagaaaacacaaaatgaggttatggaaagaagtttaaatagccagagtaaatatattaaaattactaattagaggaagagattatcaaattggctaagaaccaaaatcctgttatatgctgcttacaagaaatgcacctaaaataaagacacatggaaaggttaaaaaagaagactgggaaaacatacgcctggtaaatgaatacaaaaaaggtaatgtaggtatcttaatattagaaaaaataattttaagaacraaagactttaatagcattaaaaatactaaacaataacaaaaggaatagtagcaagaggataataagacttgtgtatgctaatagcatagcctaaactgtgtaaaagaaaaactgacagaactaaaagagaaatcaaaaaattcacaatcacaggaggaaattttaattgaatctctaagaatcagatgtctcaatttgccagaaaattaaacagatatagatgatttacataacaaattgataagcttgtccataaatgtctgtaaaaccctgtacctaagaaacacatagagagaaatt

SEQ ID NO: 205653 - DNA, 601 bp, Human
aaaattcaccaggttgtaggtgacaaaataagtctgaacaaatttcaaaataatgaagaccacattctctaacatgatgcaatcaaatcggaaataaaattgtgaaggtagtataacaggccatatgtttgaaagcaaaaatgtatacttttaagtaattcatggattaagaaggaaatgaaatggaaattacatcagaagagaatggcaatgaaagtactacatatctatacgtgagatgtatctagaacaaaccttagaggttaaaaacatgtattagaaaagaacacttgaaaataartaagctaataattcatatcaagaaggtaggaaatgagcagactaacagaccaaaaagtaaactgcaaaacaagataatagtaaagaaagagcagaaatagaaaacagaaaggaaagatgataaagaggatcagtgaaacccaaggtttgctctgcaacgaaaacctctaaaaagagagatataaaaatatgaatacatgacaatgaaacaaagcatcccctaatgattctcttccttctctccaaagtccaggtgcttcaggaaattttattgtaacttcacggaacaaataattttttt

SEQ ID NO: 205654 - DNA, 601 bp, Human
caccagcactaagtaatcaaaaagtatagtagaaaaaacagtatttataacagcaccacaaatcatggggtacatagaactatatgtaatacaaatatttaagatctttattttcttgcgatggagtctcactcgctcactcaagctagagtgcagtggtggaatctcagctcgctgcaacctctgcctcctgagttcaagcgattctcctgcctcagcctcctgagtagctgggactacaggtgcacgccaccacacctggctaatttttgtattttttagtagagatggggttttactrtgttggccaggctggtcttgaactcctgacatcaggtgatctggctgcctcggccttccagaatgctgagattgcaggcgtgagccaccatgtctggccaaatgcttaagatctttatggagaaaattataattataacatggtattgaaggacatccaagaagacttgaataagtggagagctatgttattgttttcatagtagtaaaataaaaccttgcgtaagtcctcattctaccacatgttaactaaccctctagctgatagtacaaacactcactgcgggattttatttataag

SEQ ID NO: 205655 - DNA, 601 bp, Human
cactgcatctgtgcttggttcactctagtctattctcaaccgaggacagccagagtgattttgtaaaacataagttttatcatttcctctcccgctcaaaactccaatgtggctacccattttactcagagtaaaatccgtagtccttaaccatcccacaaggtcctacactatctggcttatctgatctttgtcctgctacttcctccttgtttattccactcaagccacactggcttccttcctgccccttagaaatagcaggcacattcttgttgcccctgtaggactgctttctctrccccttgctggggatatctgaatgggtgagtgcctcactgcctccatggctttgtttgcagtcaccttcccttggaggctcaccctatttaaaattgtgctttcccagcccacctgatctctctgacctgctctgcttttcttttcattttttatagctcttgttaccttcaaactatgtcatctacctaggatttttggtgtttttaatctttttcccactagagtatacacactaaacagggtaggatcttgtttgctttgttcactcatttatcctgggtgcttagagcacttcctg

SEQ ID NO: 205656 - DNA, 601 bp, Human
gtagcagtgatcccagagtgcccaggcaatagctgtatcttataactcaatggagtcttgctatattcccagataaaagtgtactgttttggggactaggacctctaactctacagagccaagagtgtgggaacaaaagctacaaagtctcccgatgggtccctgagatagtaaatgaagtcaatcctgtttctctcctttgctttccaaacacgtgtattattcatttggggaacatggtgtgtccctacctttggagtgtttgattcagtgtcctggagtccggcacccacctgcacaatttgttcactgaactggtgctgtggctgtgccttggggctattccagtgctttttcaggacggcagttcctggtgacgtgcagtaaaataaaacaggtggaaaccagctgtgggctcactgctgcattttccttgctgcaaagtgagttgcttggtctgatggatgttatttaggggacagaagttggccaagaccctgaaggcaggaaagtcaaacacgtgccaagaatacatgtatgtgagtgtaagaacacatcactggccctttcagcatggaaggggcccggtgtaatcctttgc

SEQ ID NO: 205657 - DNA, 601 bp, Human
ctaactctacagagccaagagtgtgggaacaaaagctacaaagtctcccgatgggtccctgagatagtaaatgaagtcaatcctgtttctctcctttgctttccaaacacgtgtattattcatttggggaacatggtgtgtccctacctttggagtgtttgattcagtgtcctggagtccggcacccacctgcacagtttgttcactgaactggtgctgtggctgtgccttggggctattccagtgctttttcaggacggcagttcctggtgacgtgcagtaaaataaaacaggtggaaascagctgtgggctcactgctgcattttccttgctgcaaagtgagttgcttggtctgatggatgttatttaggggacagaagttggccaagaccctgaaggcaggaaagtcaaacacgtgccaagaatacatgtatgtgagtgtaagaacacatcactggccctttcagcatggaaggggcccggtgtaatcctttgccaccttatggtgggttggtcctctcaaggagtggtgctgtgtgaggcacttggtgacagtctctgttgctggccatttggacatttggtggtggcagtagctag

SEQ ID NO: 205658 - DNA, 601 bp, Human
cttaccttttgatgggaaatttcagccacatcatcccctagtgctccatggctgccatggtgtgcactgtgcagtgtgcttcattatcacccatgtcatgatcttgaagtgctttttcccattaaactaggcttcttggtgaaatggtcgattctgggactggggtaggaaatgtgcaaggtgagtctgggacatcctgtcaaaccagagagcaaagaagctatgagacaactgaggagaaggagccaatttgaagagggtctcactggccaaagatatgactgctgaagcttacatgagrgcagtcattgaaacgatcaaatatgtttaaatgaatatgtttgtgatgatgtttaaaaaactcttcgattagcctgggagatagcaagttcgtcatcttgaagacactatgtaaatggatgaagcaagcatttatcttccctgtcccatgtgaattgtaccactgagtaacaaagtagtagctgaggggaagcttttcattataaggtatgaaaatgaagtgatagaattagaagatcactattttgcaactctccaggaattaatacatctaggcattgagcacccatcaatgctaact

SEQ ID NO: 205659 - DNA, 601 bp, Human
tgtttgtgatgatgtttaaaaaactcttcgattagcctgggagatagcaagttcgtcatcttgaagacactatgtaaatggatgaagcaagcatttatcttccctgtcccatgtgaattgtaccactgagtaacaaagtagtagctgaggggaagcttttcattataaggtatgaaaatgaagtgatagaattagaagatcactattttgcaactctccaggaattaatacatctaggcattgagcacccatcaatgctaactagacatgaaagagacaactagacattttgtgctttctmatcaaagaccatccatagccccacctctagtcttgccagaggatcaagtctgagtctgatgaagcctctggatccaattgtcaacttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccggatgtggtggctcacgcctgtaatcccagcactttg

SEQ ID NO: 205660 - DNA, 601 bp, Human
gacatgaaagagacaactagacattttgtgctttctaatcaaagaccatccatagccccacctctagtcttgccagaggatcaagtctgagtctgatgaagcctctggatccaattgtcaacttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccrgatgtggtggctcacgcctgtaatcccagcactttgggaggcggaggggggcagatcacctgaggtcaggagttcgagaccagcctggccaacatggcgaaaccccatctctactaaaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaaga

SEQ ID NO: 205661 - DNA, 601 bp, Human
aagcctctggatccaattgtcaacttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccggatgtggtggctcacgcctgtaatcccagcactttgggaggcggaggggggcagatcacctgaggtcaggagttcgagaccagcctggccaacatggygaaaccccatctctactaaaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtc

SEQ ID NO: 205662 - DNA, 601 bp, Human
acttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccggatgtggtggctcacgcctgtaatcccagcactttgggaggcggaggggggcagatcacctgaggtcaggagttcgagaccagcctggccaacatggcgaaaccccatctctactaaaawcacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtcagataacggttgctttttgggc

SEQ ID NO: 205663 - DNA, 601 bp, Human
taaagacagccggatgtggtggctcacgcctgtaatcccagcactttgggaggcggaggggggcagatcacctgaggtcaggagttcgagaccagcctggccaacatggcgaaaccccatctctactaaaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtcagataacggttgctttttgggctataaggtttctgttgggattggagtgtagcacacagggaggcatgtctagggtagatggcaaacttctgattcttgacccaggtggtggttgtaagggtgtttgcctaataacagtgcattgaaatatatgtttgttttgtgtggtttttttgcatcagttttgtttt

SEQ ID NO: 205664 - DNA, 601 bp, Human
aaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtcagataacggttgctttttkggctataaggtttctgttgggattggagtgtagcacacagggaggcatgtctagggtagatggcaaacttctgattcttgacccaggtggtggttgtaagggtgtttgcctaataacagtgcattgaaatatatgtttgttttgtgtggtttttttgcatcagttttgttttataacaaaaggctaaaaataagtatttaaagaaaatagtgcatactatattttatttgctgatattcataatgatcaccagattattgaaatttatgagtaattttgctataaataagcctgttttct

SEQ ID NO: 205665 - DNA, 601 bp, Human
gtttaaacacacacacacacattttcacactcacaccttcaaagccacataatagaatgtttagcttaaacctgcagccgctagttgaaatgttgcttcatggagttttatcctcctaacaacctgtgtcctaagtcacattcctctccagaaatgtggacattgaccatattccagtccctgagacgctgtttcagccacacgtggcaccccagacccttgcccacctgcatcctggtcattcatcctcctcctcatggggtcatttcttgatccctattaagcattaaaaggggattamatatctctctacttgcagctaatgttttgcttggtttggccaagaacattttaagttttaaaaacctggggctattggagtgggaccatgggcaaaggtcaggacaggctagctactaaaatggcctgccacggaccttgtacgtgaaggttgaaggattctggtgctctctggtgccatcgctgttagtcgttgtgcagcacagaaatattttattcaacaaactctgcagactcctgaactttaggggtgggctgccttctgcctggtgctctgcacagatcctggagctctcgtggt

SEQ ID NO: 205666 - DNA, 601 bp, Human
atgggcaaaggtcaggacaggctagctactaaaatggcctgccacggaccttgtacgtgaaggttgaaggattctggtgctctctggtgccatcgctgttagtcgttgtgcagcacagaaatattttattcaacaaactctgcagactcctgaactttaggggtgggctgccttctgcctggtgctctgcacagatcctggagctctcgtggtcatttatgtgcagtgaagctgctccactcacctacagcttgtccttttccagagaatccctatcatcctcccctcatcccaaggaatrcaacaaaggaaaattaatagtgaatgcttttgccggagacctgtggatacttaatttttatagatactcaataaatatttatttatattcactagcagcaagcaattcacttgtaaactggtatagtggcgggtaacataagcataagcagattcttatgttatttctttgaatattttgcttttctttaaaaatgtaaattttttattcttaaagtaataggaatttattacagaaaaatttgaagaatgaaaaaatattcctaaattgtcaccactgtaatacagtagtggttattat

SEQ ID NO: 205667 - DNA, 601 bp, Human
gcttctcactttatatgtttagaagatgataatcttcctgtggagtgcaccatttagcttttgctgtggaacaaccactctaaaacatggtggcttaaaacagtcattttattagcttgtaattctgatgatcagcagttgaggctgggctcagctttatggttcttctgttagcctcacctgggatttgctcatgtggctaaggtcaacctgtgggttgcctgggggctagtcagcctaggctgctttactctttggcctggcagttggtgctggctgctggttagcactaactgccagstggggtaatggggatgatggaccatatgtcttcagcacactggcctgagctaattcacatggtggtggatgcagagaacctaagagcagcaagagaggatgaggcccattctctgtttgtgttacgttcacttttataccattggccaaagcaagtcatatgcgctagctagaccagagccaatatgggatggctccccaaaggcaaggatataggaggtatcaagaatcgggaccattatttcaacaatctaccacatgagacagacatttcagatactggttgtgttttctgtaagga

SEQ ID NO: 205668 - DNA, 601 bp, Human
tatctattgctttatacctattatcctcaagcagcaaaatgttaacaatcagttagaatattgtgattccttgtttgctcgaacccttttcagttcagctgtttaccttaataacaacatgataattgccatgtgttaaactcatgctatatgccagacactgtaataagcactttttctgtctttgcttttctctaagcagttccatgaagtatgtcagcttctatcttttacagagggagtgtagaggctcagagaggataaataacttacctaaggtcatacctagcaggaatccctmcctcattagctctcagctcaaagtctatgccattgaccatggtgtaagtctcccagctgtcatcatatcccagccattctccattcatccctttgcactttcttccaccaagtcacaaattctctttcatatatgtccctctggtatatttttaattatattagtgtgcttttaaatgattaaggagaatgccaaggaaattcttttgtctttcttatgtttagaaggaaaaagggccaagccagttcatgcaaacagctggtatgttagaggcctctagcaagtggtaaagtatggaaa

SEQ ID NO: 205669 - DNA, 601 bp, Human
tccctccctcattagctctcagctcaaagtctatgccattgaccatggtgtaagtctcccagctgtcatcatatcccagccattctccattcatccctttgcactttcttccaccaagtcacaaattctctttcatatatgtccctctggtatatttttaattatattagtgtgcttttaaatgattaaggagaatgccaaggaaattcttttgtctttcttatgtttagaaggaaaaagggccaagccagttcatgcaaacagctggtatgttagaggcctctagcaagtggtaaagtayggaaaccacagagactggtaaagaactcgattggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaa

SEQ ID NO: 205670 - DNA, 601 bp, Human
agactggtaaagaactcgattggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaaataaggtccctmgctagagtaattatggtaaccagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattgtgggagaaatactagtctgtactctagtatctgcttgcaattaagtttgtaaaactttgatcacaa

SEQ ID NO: 205671 - DNA, 601 bp, Human
tggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaaataaggtccctcgctagagtaattatggtaascagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattgtgggagaaatactagtctgtactctagtatctgcttgcaattaagtttgtaaaactttgatcacaatccgtgaatattttgtaaag

SEQ ID NO: 205672 - DNA, 601 bp, Human
ggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaaataaggtccctcgctagagtaattatggtaacyagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattgtgggagaaatactagtctgtactctagtatctgcttgcaattaagtttgtaaaactttgatcacaatccgtgaatattttgtaaaga

SEQ ID NO: 205673 - DNA, 601 bp, Human
gttctgatcataaaagggaaaaacaaaaaggcagagaggagctatgatagaaaggtccctctggcacagaagtggtacagccttcagatccctgggaataacagggaaggagaacaaataaggtccctcgctagagtaattatggtaaccagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaayaaacaaacaaacaaaaaccccaaggctctggtaagatgcatagtaattgctgaggtccattgtgggagaaatactagtctgtactctagtatctgcttgcaattaagtttgtaaaactttgatcacaatccgtgaatattttgtaaagatttttacttttattttgtcaagaaaagaagcatagagacctggattgtgtgcagattccttctctcataaagcggtatgcttgagcttaaggtaccatgtggtttcttggggcagatgccagaaatataggaggaggggttaacagaatcc

SEQ ID NO: 205674 - DNA, 601 bp, Human
ggcacagaagtggtacagccttcagatccctgggaataacagggaaggagaacaaataaggtccctcgctagagtaattatggtaaccagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattrtgggagaaatactagtctgtactctagtatctgcttgcaattaagtttgtaaaactttgatcacaatccgtgaatattttgtaaagatttttacttttattttgtcaagaaaagaagcatagagacctggattgtgtgcagattccttctctcataaagcggtatgcttgagcttaaggtaccatgtggtttcttggggcagatgccagaaatataggaggaggggttaacagaatccacagggccagctttaccaccgctctgtgcaacctcttatgtgatgacgcacatcagagcttc

SEQ ID NO: 205675 - DNA, 601 bp, Human
tttacttttattttgtcaagaaaagaagcatagagacctggattgtgtgcagattccttctctcataaagcggtatgcttgagcttaaggtaccatgtggtttcttggggcagatgccagaaatataggaggaggggttaacagaatccacagggccagctttaccaccgctctgtgcaacctcttatgtgatgacgcacatcagagcttccacaagcattatctcagcacacaggtgggtgaacacaggccaaggaaccatcggctcaagtttgctacccctgctgtgccagtgggtctkcacagcctcaacaggggagaagtgagcgagagagtgtggatgtgagtgtagaagcagtgtgtgtccagagagggtgtggattcatgtccgaatggtatttctatgtggaaattgataggccagtgactctgaaccccaaatcggagttgtgactaggcatatagaaaagataacatggcttctcatagtagctgagagaggaggtgtccccatcgtgggctcactaatggggctgttcatggtgggcagtctccattgcttggtgccacttgcacccgacatgcgtagagaatacaaggg

SEQ ID NO: 205676 - DNA, 601 bp, Human
actaggcatatagaaaagataacatggcttctcatagtagctgagagaggaggtgtccccatcgtgggctcactaatggggctgttcatggtgggcagtctccattgcttggtgccacttgcacccgacatgcgtagagaatacaagggggcggtctcttaggaatttagaataaagtcgcccattgagagtggcagtataaaatcagcctgctctgaatcacagtggagatggacagtcacttggaagagagattggtttctgtgtctgtaggatttcagagtaacctagtggaatgccytgactgtgtaaaaggagcataggtcctcagtaggaggttggtgagctagaacagcctgggagaggggaggtcctggccactctcttgggtgttctgggcagacccacagagcctgataccctggcacttttaagttgtatcactaacctcgtgttctgatccatactctgtaaaactttctaatcttttgtcctcctgtggggattatttacagaaagaaaatgcaatgaaatcaggttagtcaggcagacagttctaattcttatttagaattcaataaaatgcctctctgagatacat

SEQ ID NO: 205677 - DNA, 601 bp, Human
ccctgactgtgtaaaaggagcataggtcctcagtaggaggttggtgagctagaacagcctgggagaggggaggtcctggccactctcttgggtgttctgggcagacccacagagcctgataccctggcacttttaagttgtatcactaacctcgtgttctgatccatactctgtaaaactttctaatcttttgtcctcctgtggggattatttacagaaagaaaatgcaatgaaatcaggttagtcaggcagacagttctaattcttatttagaattcaataaaatgcctctctgagatayatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaacctataatcttcccttcctcaggttcattaagcactgaaccaatagtgcacaggctgagaaacttacctcacccagatgt

SEQ ID NO: 205678 - DNA, 601 bp, Human
aaaatgcaatgaaatcaggttagtcaggcagacagttctaattcttatttagaattcaataaaatgcctctctgagatacatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaayctataatcttcccttcctcaggttcattaagcactgaaccaatagtgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtca

SEQ ID NO: 205679 - DNA, 601 bp, Human
tcttatttagaattcaataaaatgcctctctgagatacatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaacctataatcttcccttcctcaggttcattaagcactgaaccartagtgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggc

SEQ ID NO: 205680 - DNA, 601 bp, Human
atttagaattcaataaaatgcctctctgagatacatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaacctataatcttcccttcctcaggttcattaagcactgaaccaatagygcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggcacta

SEQ ID NO: 205681 - DNA, 601 bp, Human
taacctataatcttcccttcctcaggttcattaagcactgaaccaatagtgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagaktcatccatccatttctgtttcctacaagctcagcatctggctggcactagggaacccagaacgtggactggaatagccatgaggagcctaacttgtatataggccttacttgaataaattaaatatgccacttactggaaaggtgccacatgtaaagcattgcaccaggtcctaggggaaggttggttttgatgtaaagaatactagttcctgtcttccagaattttctctatagtcaaatgaaagcttgatctttcacatttgttttaagaagttgggctgacactggttttctcttta

SEQ ID NO: 205682 - DNA, 601 bp, Human
cacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggcactagrgaacccagaacgtggactggaatagccatgaggagcctaacttgtatataggccttacttgaataaattaaatatgccacttactggaaaggtgccacatgtaaagcattgcaccaggtcctaggggaaggttggttttgatgtaaagaatactagttcctgtcttccagaattttctctatagtcaaatgaaagcttgatctttcacatttgttttaagaagttgggctgacactggttttctctttacacatgcacacacacacacacaccctcaaacagttgttatgcaaaccaact

SEQ ID NO: 205683 - DNA, 601 bp, Human
aacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggcactagggaacccagaacstggactggaatagccatgaggagcctaacttgtatataggccttacttgaataaattaaatatgccacttactggaaaggtgccacatgtaaagcattgcaccaggtcctaggggaaggttggttttgatgtaaagaatactagttcctgtcttccagaattttctctatagtcaaatgaaagcttgatctttcacatttgttttaagaagttgggctgacactggttttctctttacacatgcacacacacacacacaccctcaaacagttgttatgcaaaccaactgattaactggca

SEQ ID NO: 205684 - DNA, 601 bp, Human
ctgggctggggactgcctgggcctgcagaatcagggcaagtggactgcaaattgatttgtccacgaagcatgggctgcagaccttacatataataacctagtacgcacctgctccagtttacagtatacaagggtgatggcattgcaataagtaaaacatgcactcagccagtgctattgaattcagagcaatttttcaccatcacataggtccttcatccaccggttctaaaatttgagtgactctatgggggttctctggcagtatctaggcgaaatcatgtggtctctcatactcacrtaggtatgaaccctgtatgctgataggtagttcaaagttgaaaccaaagagacgtgcacattttgctagaggtatcccaagtttgcccagttatttaaatccagcattagacatcagagagggtgaggattttctatagcttcaaataactgaaggctggcaagcagcaaaacatagggccccacaatcctgctgtcctcgaatggtaaaaagaggcatttagtgcctttccttccccttcaggccattggctaaagactccaataatgtcagggtctgttctttgtcattgaagggcaa

SEQ ID NO: 205685 - DNA, 601 bp, Human
gtatacaagggtgatggcattgcaataagtaaaacatgcactcagccagtgctattgaattcagagcaatttttcaccatcacataggtccttcatccaccggttctaaaatttgagtgactctatgggggttctctggcagtatctaggcgaaatcatgtggtctctcatactcacgtaggtatgaaccctgtatgctgataggtagttcaaagttgaaaccaaagagacgtgcacattttgctagaggtatcccaagtttgcccagttatttaaatccagcattagacatcagagaggrtgaggattttctatagcttcaaataactgaaggctggcaagcagcaaaacatagggccccacaatcctgctgtcctcgaatggtaaaaagaggcatttagtgcctttccttccccttcaggccattggctaaagactccaataatgtcagggtctgttctttgtcattgaagggcaaggggtgagtgaattggatggtttatggactctctaaagactattgcatgtgctacgtgttcttcatatgaccttgatattttaatattctatagttggtttggctgttcaactcacgtctctc

SEQ ID NO: 205686 - DNA, 601 bp, Human
gagagggtgaggattttctatagcttcaaataactgaaggctggcaagcagcaaaacatagggccccacaatcctgctgtcctcgaatggtaaaaagaggcatttagtgcctttccttccccttcaggccattggctaaagactccaataatgtcagggtctgttctttgtcattgaagggcaaggggtgagtgaattggatggtttatggactctctaaagactattgcatgtgctacgtgttcttcatatgaccttgatattttaatattctatagttggtttggctgttcaactcacstctctccttgaacagcttaaatcactgctgaggaacaggtgcagcggtcaaaggtcaacagactgacagactttaagtagttaaatgtgtcaatatttcagcaattttggtggtaaaattcaaatagggcatttaagtagaaaacaaatggaaaggaacaataataaaaacatccttttacccattcaacactagaaataggttattctttcattgttttaggattatattctcaaagacttagaagggagattaagaggaatttgatatagcaagcagtttttaaaacataattgcaaa

SEQ ID NO: 205687 - DNA, 601 bp, Human
tgtcaatatttcagcaattttggtggtaaaattcaaatagggcatttaagtagaaaacaaatggaaaggaacaataataaaaacatccttttacccattcaacactagaaataggttattctttcattgttttaggattatattctcaaagacttagaagggagattaagaggaatttgatatagcaagcagtttttaaaacataattgcaaaagcagttgatgaatgtgcccacactgatgttttcaaatcacatctaatggagccataatgtaatatgagaaaataaccttatggggggtcagggggttgagcttctccaggaattttatgggatatgctgggtcttaattacttcataatgactgacaatttttagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcag

SEQ ID NO: 205688 - DNA, 601 bp, Human
caaatagggcatttaagtagaaaacaaatggaaaggaacaataataaaaacatccttttacccattcaacactagaaataggttattctttcattgttttaggattatattctcaaagacttagaagggagattaagaggaatttgatatagcaagcagtttttaaaacataattgcaaaagcagttgatgaatgtgcccacactgatgttttcaaatcacatctaatggagccataatgtaatatgagaaaataaccttatggggggtcagggggttgagcttctccaggaattttatgrgatatgctgggtcttaattacttcataatgactgacaatttttagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtcatttacaaaccaccgaggcccct

SEQ ID NO: 205689 - DNA, 601 bp, Human
aaataggttattctttcattgttttaggattatattctcaaagacttagaagggagattaagaggaatttgatatagcaagcagtttttaaaacataattgcaaaagcagttgatgaatgtgcccacactgatgttttcaaatcacatctaatggagccataatgtaatatgagaaaataaccttatggggggtcagggggttgagcttctccaggaattttatgggatatgctgggtcttaattacttcataatgactgacaatttttagagccttagaataaaggtttctttttttttyctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtcatttacaaaccaccgaggcccctcagctgcgggagaagctttgcttaataaatcctggcctctgaggcgtggaattgtgaagtctctcagggaatgcc

SEQ ID NO: 205690 - DNA, 601 bp, Human
tgagcttctccaggaattttatgggatatgctgggtcttaattacttcataatgactgacaatttttagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtyatttacaaaccaccgaggcccctcagctgcgggagaagctttgcttaataaatcctggcctctgaggcgtggaattgtgaagtctctcagggaatgccgagggacagaactaatttcagcgtcttcgttctttgagaatgggaggtagcatcacgtctctgactggagcgttctgatgagggtgaccacctacccacaacgtgttttgaactcttttatttatagttgttgccttcctctttctttcttgacgtttcctcttcctcctgcttcccctctcttctcttttgcttcttcttt

SEQ ID NO: 205691 - DNA, 601 bp, Human
tagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtcatttacaaaccaccgaggcccctcagctgcgggagaagctttgcttaataaatcctggcctctgargcgtggaattgtgaagtctctcagggaatgccgagggacagaactaatttcagcgtcttcgttctttgagaatgggaggtagcatcacgtctctgactggagcgttctgatgagggtgaccacctacccacaacgtgttttgaactcttttatttatagttgttgccttcctctttctttcttgacgtttcctcttcctcctgcttcccctctcttctcttttgcttcttctttccttgagttaaggataagttgttttttccactctggtttattgttataaggcttaaaagaagtcac

SEQ ID NO: 205692 - DNA, 601 bp, Human
tgcaagatgctgtgattgggagagggggcttcccccagcactgtcctcagtattctggccctagagtgctgcctcaaaacctaccaggagcttagtctgtaaagcagttgaggactagggccaagttaactttgggctgaaacacgcagtaacatgagaaggccttccacacctcgctcatcactagcccactgcaaggctgcactttgcatgctcatggaaactcgcaggattattgaggaggctgtgcagagggaaggggccttttaattctctgcctccttagaggtgcaccctggcrggccaggagccccaggcagagatgtttctgtacaggtcccaggttttgcagcaaggtcccagagcatcccgttctcccagtgaaattccgttttcaatttcagcctgattccctgagtgaatttaatgtaaagctgtcccttccccctcggtcccggcaggtaaggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgt

SEQ ID NO: 205693 - DNA, 601 bp, Human
gaatttaatgtaaagctgtcccttccccctcggtcccggcaggtaaggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgtttaaggcgtgttcggttgcgtttgatagtttgaaaatgctctggggaacaatcatctgtctggttttgagagtcaggtcgtaaaatggtgaaatcacatactgggggctggagtggggyggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtataatgagtgacctgtgt

SEQ ID NO: 205694 - DNA, 601 bp, Human
ccctcggtcccggcaggtaaggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgtttaaggcgtgttcggttgcgtttgatagtttgaaaatgctctggggaacaatcatctgtctggttttgagagtcaggtcgtaaaatggtgaaatcacatactgggggctggagtggggcggtgggcagtgtgggggcattgggargctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtataatgagtgacctgtgtccaccatgaagttattgtacagagta

SEQ ID NO: 205695 - DNA, 601 bp, Human
aggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgtttaaggcgtgttcggttgcgtttgatagtttgaaaatgctctggggaacaatcatctgtctggttttgagagtcaggtcgtaaaatggtgaaatcacatactgggggctggagtggggcggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtataatgagtgacctgtgtccaccatgaagttattgtacagagtaatttcgctgccctaaaatt

SEQ ID NO: 205696 - DNA, 601 bp, Human
atctgtctggttttgagagtcaggtcgtaaaatggtgaaatcacatactgggggctggagtggggcggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtccycagcagccatagtttgcgttgagttcactcttgatgttctgacatgtataatgagtgacctgtgtccaccatgaagttattgtacagagtaatttcgctgccctaaaattctctgtgctcagcctattcagcccatcctccccccccaacccctggcaactgctgatcttttcggagtcttcatgtgtttgcctttttcagaatgtcattgagttgaaatcacacagcctatgtccttttcggattggcttctttcagtaatatgcacttaagtttccaccctgtcttttcacggcttgg

SEQ ID NO: 205697 - DNA, 601 bp, Human
gggggctggagtggggcggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtayaatgagtgacctgtgtccaccatgaagttattgtacagagtaatttcgctgccctaaaattctctgtgctcagcctattcagcccatcctccccccccaacccctggcaactgctgatcttttcggagtcttcatgtgtttgcctttttcagaatgtcattgagttgaaatcacacagcctatgtccttttcggattggcttctttcagtaatatgcacttaagtttccaccctgtcttttcacggcttggtaggtcatttctttttagcactgaataatattccatggcctggatgtac

SEQ ID NO: 205698 - DNA, 601 bp, Human
gtaggtcatttctttttagcactgaataatattccatggcctggatgtaccccagtttgcttgtctattcccctgccgaagaatatcttggatgtctccaagttttgacaattacggatgaagctgctgtcaacataggaaactggttttaaacgttcagtagagattaatgcaagaactctggagtgggggaggcctggaggcctgggttgaaatgaagttctaccagagaggatttctgctagctgatatcaggcaactgggggcttcatccatcaaaagcacttaacattgaaacttwcttttcttttctgagccacataagtaagaagaattcagacggcacctctgtctaggtgggtggctggtgaaaacttccaacagtacttttctctctccagagtgtaagagttcagatttgcatgtgtccattcttccctttctgtggggcagagatacatgtatttctctgtccccccgaggcgaagctatagtctctgaccccctgagtttcagcccagtgggagtgtttcttgtaagatttctcagtttgggaggaccttgggcttcatctcctgccctccttctcctgccccaaatg

SEQ ID NO: 205699 - DNA, 601 bp, Human
tctaggtgggtggctggtgaaaacttccaacagtacttttctctctccagagtgtaagagttcagatttgcatgtgtccattcttccctttctgtggggcagagatacatgtatttctctgtccccccgaggcgaagctatagtctctgaccccctgagtttcagcccagtgggagtgtttcttgtaagatttctcagtttgggaggaccttgggcttcatctcctgccctccttctcctgccccaaatggctaccaaggtgggtccagaagaaactctcagaggtctgtagtttgtttawcttctaggctttttatacatttctttccttcataatagctcagtgaaaaatgttaaaatattttaaaaatatattgtacccagcattttagttatatcaggcaggaagattgcttcagatgttgatgtgccctttcttggccagggcattgcaaggcagggttagtgctcgtagacaaacaaggattttttaggaggtgatgacaccatttccatcaggggtggccaggaatgggcacgtacagacagaagcattcaagtgacttgagaggatccttaggcagcctggaagtaagaggaa

SEQ ID NO: 205700 - DNA, 601 bp, Human
gcagagaggtgaacaccagcatgtcttgttaagaagcaggagatgagttcatgagatttccacacacacacgttgatggcctttacatatgagcttggagatagaaaataatagctaataggttttagtcgtttccaagtgcatggcataattctaaattctttacatgtgaccacttcttctattttcataacagctgggggatagggagggggtaggctagtgtccctgtttttaaaatgaacaaatccaggcataggcagattatctgacttgtgtaaacccccataattagtaagcrgcagagccagaatggacgcagggacggtctatgtctagagtcgttgttttgaactcctatgctgtgtctctctcaaagagaacaagaaagtacaagtcactacaatgaaaagaactccattgtcagtgagacatacaacacccttccaaagtgagaaagacaaaacacccagctaagactcactggctaattggaaagcaggacctgttattatgtaaaggctcctgtcctactaggtgagattttccttgagggtagggactatgtcttttcatctccctattcttgtgacacctggag

SEQ ID NO: 205701 - DNA, 601 bp, Human
tgttaagaagcaggagatgagttcatgagatttccacacacacacgttgatggcctttacatatgagcttggagatagaaaataatagctaataggttttagtcgtttccaagtgcatggcataattctaaattctttacatgtgaccacttcttctattttcataacagctgggggatagggagggggtaggctagtgtccctgtttttaaaatgaacaaatccaggcataggcagattatctgacttgtgtaaacccccataattagtaagcggcagagccagaatggacgcagggacrgtctatgtctagagtcgttgttttgaactcctatgctgtgtctctctcaaagagaacaagaaagtacaagtcactacaatgaaaagaactccattgtcagtgagacatacaacacccttccaaagtgagaaagacaaaacacccagctaagactcactggctaattggaaagcaggacctgttattatgtaaaggctcctgtcctactaggtgagattttccttgagggtagggactatgtcttttcatctccctattcttgtgacacctggagcaggccttgctctcaataggctcctg

SEQ ID NO: 205702 - DNA, 601 bp, Human
tatctgacttgtgtaaacccccataattagtaagcggcagagccagaatggacgcagggacggtctatgtctagagtcgttgttttgaactcctatgctgtgtctctctcaaagagaacaagaaagtacaagtcactacaatgaaaagaactccattgtcagtgagacatacaacacccttccaaagtgagaaagacaaaacacccagctaagactcactggctaattggaaagcaggacctgttattatgtaaaggctcctgtcctactaggtgagattttccttgagggtagggactaygtcttttcatctccctattcttgtgacacctggagcaggccttgctctcaataggctcctgatcaatgccgagttgtcacatcccctcatgcgttaaataaggccgtgtctgaggatcccactggaaagtcttggaagactctgggactcttgtaagccctgcacggtgcttcctgattatatgaggagttggagaatatcatgagaaaagtccaaagtctctcctaagttctgaactatagctcccttctcccacgtggcaactcttccctgatggtttaaagagcagaggtcttggca

SEQ ID NO: 205703 - DNA, 601 bp, Human
cgaggtgcggaggctcatgcctgtaatcccagcactttgggaggccaaggcgggcagatcgcttgaggtcaggagtttgagaccagcctggccaacatgtcgaaaccctgtatgtactaaaaatacaaaaactagccgggtgtggtggtgcaagtctgtaatcccagctacttgggaggctgaggcaggagaatcacttgaacctggaaggtggaggttgccgtgagctgagatcttgccactgcactccagcttgggtgacagagactctgtcaaaggaaaaaaaaaaaaaagaggcagwtatatatgttcatctgttgcctttgaccttgtcaaatctattgaagttctcaatgccctgaaaacaaatggacttagatctatggccactctctggcaaaactgagggaattttaaactctagcatcttttgggctgtagcaaggtgacaaaattaagtttctggagtgccccagaggctacataaatgcaattttgtcatttctggagtgttctgtaaatatcgagcctataaaacagaatgcagttacaagaagagttaattcacaggttggtgaaaggaacactgctcataattaga

SEQ ID NO: 205704 - DNA, 601 bp, Human
aacatgtcgaaaccctgtatgtactaaaaatacaaaaactagccgggtgtggtggtgcaagtctgtaatcccagctacttgggaggctgaggcaggagaatcacttgaacctggaaggtggaggttgccgtgagctgagatcttgccactgcactccagcttgggtgacagagactctgtcaaaggaaaaaaaaaaaaaagaggcagttatatatgttcatctgttgcctttgaccttgtcaaatctattgaagttctcaatgccctgaaaacaaatggacttagatctatggccactctytggcaaaactgagggaattttaaactctagcatcttttgggctgtagcaaggtgacaaaattaagtttctggagtgccccagaggctacataaatgcaattttgtcatttctggagtgttctgtaaatatcgagcctataaaacagaatgcagttacaagaagagttaattcacaggttggtgaaaggaacactgctcataattagagtcaggtggtaaaggacatacttcctggtgaagcaggtgtgtagggacccgtgacattctcccatctggagttgtctcctcctctctccctgc

SEQ ID NO: 205705 - DNA, 601 bp, Human
aggcaggagaatcacttgaacctggaaggtggaggttgccgtgagctgagatcttgccactgcactccagcttgggtgacagagactctgtcaaaggaaaaaaaaaaaaaagaggcagttatatatgttcatctgttgcctttgaccttgtcaaatctattgaagttctcaatgccctgaaaacaaatggacttagatctatggccactctctggcaaaactgagggaattttaaactctagcatcttttgggctgtagcaaggtgacaaaattaagtttctggagtgccccagaggctamataaatgcaattttgtcatttctggagtgttctgtaaatatcgagcctataaaacagaatgcagttacaagaagagttaattcacaggttggtgaaaggaacactgctcataattagagtcaggtggtaaaggacatacttcctggtgaagcaggtgtgtagggacccgtgacattctcccatctggagttgtctcctcctctctccctgctcctgtggctgggggtgggattcctaagtcactttccctccctttccccattcccatttcttctgagtacttactaggtgcaaaacatt

SEQ ID NO: 205706 - DNA, 601 bp, Human
tagggacccgtgacattctcccatctggagttgtctcctcctctctccctgctcctgtggctgggggtgggattcctaagtcactttccctccctttccccattcccatttcttctgagtacttactaggtgcaaaacatttttctggacatttgggaaagctcagaaaataatatgttgatattcccctccaggaaggtagaccgtcctgggaaacccaggactagggtttcctggggaaacaagggaaagcagtccaggcgtgtgggggagagattcagggtgctttccaccctctccyggacctcagcttccctgcacctggctttgcttttgtaggctggggctgctgctcctctcggcttcttccatggcagtcggtgccacccagctcgctggtgttcctgactcgggctctgcccgcctcaccccctctgtaggctctccctggtgggtgttctgctgttcacagtcctgatttggcacaggccctctgaggacctcaacacagacgctccagagaagaggcctggacctgcgtcactgagaatgcatcagagggagcagttccgggaaagagaaaacaaccaagtcatttcgg

SEQ ID NO: 205707 - DNA, 601 bp, Human
attctcccatctggagttgtctcctcctctctccctgctcctgtggctgggggtgggattcctaagtcactttccctccctttccccattcccatttcttctgagtacttactaggtgcaaaacatttttctggacatttgggaaagctcagaaaataatatgttgatattcccctccaggaaggtagaccgtcctgggaaacccaggactagggtttcctggggaaacaagggaaagcagtccaggcgtgtgggggagagattcagggtgctttccaccctctcccggacctcagcttcyctgcacctggctttgcttttgtaggctggggctgctgctcctctcggcttcttccatggcagtcggtgccacccagctcgctggtgttcctgactcgggctctgcccgcctcaccccctctgtaggctctccctggtgggtgttctgctgttcacagtcctgatttggcacaggccctctgaggacctcaacacagacgctccagagaagaggcctggacctgcgtcactgagaatgcatcagagggagcagttccgggaaagagaaaacaaccaagtcatttcggttggacgggacata

SEQ ID NO: 205708 - DNA, 601 bp, Human
caaaacatttttctggacatttgggaaagctcagaaaataatatgttgatattcccctccaggaaggtagaccgtcctgggaaacccaggactagggtttcctggggaaacaagggaaagcagtccaggcgtgtgggggagagattcagggtgctttccaccctctcccggacctcagcttccctgcacctggctttgcttttgtaggctggggctgctgctcctctcggcttcttccatggcagtcggtgccacccagctcgctggtgttcctgactcgggctctgcccgcctcaccccytctgtaggctctccctggtgggtgttctgctgttcacagtcctgatttggcacaggccctctgaggacctcaacacagacgctccagagaagaggcctggacctgcgtcactgagaatgcatcagagggagcagttccgggaaagagaaaacaaccaagtcatttcggttggacgggacataaacactgcaagacaaaattgatgcacaataatgatatgatctgtcagaagaagtggcaaagaaagggaagaaatgagcggctgtgtgtgggcgagccattgatgcaggaggctctcct

SEQ ID NO: 205709 - DNA, 601 bp, Human
tggcacaggccctctgaggacctcaacacagacgctccagagaagaggcctggacctgcgtcactgagaatgcatcagagggagcagttccgggaaagagaaaacaaccaagtcatttcggttggacgggacataaacactgcaagacaaaattgatgcacaataatgatatgatctgtcagaagaagtggcaaagaaagggaagaaatgagcggctgtgtgtgggcgagccattgatgcaggaggctctccttgccatttggtccagttgcagcagaataaaaaaagctccacttctggwtgagggatctcacatgacaagtatgcaagagctgtttaataccaccacgcctggccagtgacaggggcacggcatcctggttagtaatgaaagtggagtgagaaagctgcaggagcctgagatggatggaacagggaaggagcaaagtttccacagaggagacagaggaggaggaagcgggggacagaataccccacgactctagcggcacacgtacacaagcgaggcagcacgcagagttgacaggcacagatggactggtcacgtagcctggagttagggcaacagatggacaagtca

SEQ ID NO: 205710 - DNA, 601 bp, Human
acaggcacagatggactggtcacgtagcctggagttagggcaacagatggacaagtcattgcataaattggctacccagggaccacaaatgcctgctaggaaatccaaggacgtatcatgttgacccagtgacaacatacctgggcagaggtagacacaggtgcccctgatgtgaaagggaaatgaacagcagtttgcattggtgggggggaataaaaagcaaacgagattaataaggaaaggaaggaaattacattgtgtgcgtgtgtgtgtgcttaatgtcttttgtaagaggacttayctttaattcatctttgtaagacctgactttaattatgtcacttctgaatgttgtaatcgtatgactttcagagcagtgggagaggaaaataacatttggatatttgatagatattcaaaatatagctgaaataaattttctaaacactgaatctttagtctaagcacaaagtgaaaaacaataactttcatggaaatagttacttgtaaaatgttgttcagctttcagaatgaagtataaaatacaagatggagttgtcatttaaaaaccaaatagtactaaactaaaacaaaagtaatt

SEQ ID NO: 205711 - DNA, 601 bp, Human
tcagaatgaagtataaaatacaagatggagttgtcatttaaaaaccaaatagtactaaactaaaacaaaagtaattcttgctagatatatttaggttgctgtaatagtgtacccaaaaaaaaactatagtctgctgtgatggtattgattacctttttatttatggtaaaaatggatgaattgtcatgtctttaagttgctatttactcaatattttaatatacatttagtatatacatttgtgttaattcttttttaaagctttaaaaattaatcacgtaatctttgaaagtcactatgstagggaccggatacagtggtgaacaggataaaattgtttctgtcttcatgaagggtatataatctattacttaaaaaaaaaaaaaaaaagactataaggccagatgtggtggctcatgtctgtgatcccagcattttgggaggctgagatgggaggattgcttgaggccaggagtttgagaccaggctgggcaagaaagcaaggcattcgtttctacaaaaccttttttttaaggactttaatttttagagcaattttaggtttaagcagaaaaagtaagcaggaagtacacagagttcc

SEQ ID NO: 205712 - DNA, 601 bp, Human
gatacagtggtgaacaggataaaattgtttctgtcttcatgaagggtatataatctattacttaaaaaaaaaaaaaaaaagactataaggccagatgtggtggctcatgtctgtgatcccagcattttgggaggctgagatgggaggattgcttgaggccaggagtttgagaccaggctgggcaagaaagcaaggcattcgtttctacaaaaccttttttttaaggactttaatttttagagcaattttaggtttaagcagaaaaagtaagcaggaagtacacagagttccgatgttaccrcctgccacacatacatccattttcttggctattaacatcttagtgtagtacatttgttatcactgatgggccaatactgatatgttattattaactaaagtccatagtttacattcgggttcacttttggtgttgtacatgctgtaggtttgacaattgtataataagtgtatctaccattatagaatcatgcagaatagttcactccctaaagattccctgcgctccacctgttcatctctccaccctcacaaacccctggcaatcactagctttttacctttgatagttccgcctttt

SEQ ID NO: 205713 - DNA, 601 bp, Human
cagaatagttcactccctaaagattccctgcgctccacctgttcatctctccaccctcacaaacccctggcaatcactagctttttacctttgatagttccgccttttccagaatgtcaagcagctgtgtgattcgagaatgggtggaagcatacagtaaatagcatgtttagataggtctttttcacttagcaatatgtatttaacggtactccatgtctttctggggcttgatggcttatgtctttttatcactgagtaataatccactgtttggaggtaccataggttattttatctmttcagctcttgaaataattgcagttgcttccagtttttggcaattatgaacaaagctgctattaacgtttgtgtacaggtttttatgtgcacataagtttttaactcatttggacaaatatttaagaatgtgattgctggatcatgtggttagcctatgtttagctttgccataaattgtcaaactgtcttccaaagtgactgtaccattttgctaccagcagtgagtgggagttcctgttactttacatccttgccagcatttggtgttgttggtgttttggattttggcaattctgat

SEQ ID NO: 205714 - DNA, 601 bp, Human
ctttttacctttgatagttccgccttttccagaatgtcaagcagctgtgtgattcgagaatgggtggaagcatacagtaaatagcatgtttagataggtctttttcacttagcaatatgtatttaacggtactccatgtctttctggggcttgatggcttatgtctttttatcactgagtaataatccactgtttggaggtaccataggttattttatctattcagctcttgaaataattgcagttgcttccagtttttggcaattatgaacaaagctgctattaacgtttgtgtacaggkttttatgtgcacataagtttttaactcatttggacaaatatttaagaatgtgattgctggatcatgtggttagcctatgtttagctttgccataaattgtcaaactgtcttccaaagtgactgtaccattttgctaccagcagtgagtgggagttcctgttactttacatccttgccagcatttggtgttgttggtgttttggattttggcaattctgataggtgtatagtggtatctccttattgttttaatttgcaattctttaatgacatatgatgtggagtatgttttcttatgct

SEQ ID NO: 205715 - DNA, 601 bp, Human
aggtgaattgcaggcctccacagccaggctctgttagtcccaatattctcccagaaagtcaggttggactgttgcatgcccgaatgttggcactcacacctttcttgttcacttgcttctattgaccttgttactgggttgtacctatggttttggcctctcattttttgccgtgttggtcattttgtgcttctgatgactttagtagctgactctggccctggtcccttgacttcctgcaagttctgttacctgactgtggccatccaccctcccacatgggtgctgattgtcttgtttgtgtaccggcttggcctttgccagtgacagtttatcctgaccccagcccgaggcctagtgtctagaaaaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttct

SEQ ID NO: 205716 - DNA, 601 bp, Human
gtcaggttggactgttgcatgcccgaatgttggcactcacacctttcttgttcacttgcttctattgaccttgttactgggttgtacctatggttttggcctctcattttttgccgtgttggtcattttgtgcttctgatgactttagtagctgactctggccctggtcccttgacttcctgcaagttctgttacctgactgtggccatccaccctcccacatgggtgctgattgtcttgtttgtgtaccggcttggcctttgccagtgacagtttatcctgaccccagcccgaggcctaktgtctagaaaaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttctcagagtgcttcagtgcttaccattcattctattaaaggacttgagttctaccatgat

SEQ ID NO: 205717 - DNA, 601 bp, Human
ttgccagtgacagtttatcctgaccccagcccgaggcctagtgtctagaaaaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttctcagagtgcttcagtgcytaccattcattctattaaaggacttgagttctaccatgataggaaaaaagactacatcattccaggaaggtatgtgtgcacgttcagacaataggttaatgccatatgcatttttctgaaaaccctgtatctccctatatggcagcctctaagagcctttgtggtaccaaaaccgggaatcattctttggctttgtttttaaacactgaaatccttcttcagtcttctctcttttttattcccactgccaccgatgtgaaactggccctggcttcatggctggccccttgaggcttcgtg

SEQ ID NO: 205718 - DNA, 601 bp, Human
aaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttctcagagtgcttcagtgcttaccattcattctattaaaggacttgagttctaccatgataggaaaaaaractacatcattccaggaaggtatgtgtgcacgttcagacaataggttaatgccatatgcatttttctgaaaaccctgtatctccctatatggcagcctctaagagcctttgtggtaccaaaaccgggaatcattctttggctttgtttttaaacactgaaatccttcttcagtcttctctcttttttattcccactgccaccgatgtgaaactggccctggcttcatggctggccccttgaggcttcgtgctggactcaacaccttgggtctttctgaagggaagcctgctggggacagg

SEQ ID NO: 205719 - DNA, 601 bp, Human
ctttagagtgagatcttcacagtgtgatttcgttattgtatttgaagtgaatgctagaatagctgatgcttttagaaatcaaatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcracagaggaagcagagccctccaagtttatatgagattgattactccaaagctttgactagagacctgttcttgtagaagccagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcac

SEQ ID NO: 205720 - DNA, 601 bp, Human
tttagagtgagatcttcacagtgtgatttcgttattgtatttgaagtgaatgctagaatagctgatgcttttagaaatcaaatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcarcagaggaagcagagccctccaagtttatatgagattgattactccaaagctttgactagagacctgttcttgtagaagccagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcaca

SEQ ID NO: 205721 - DNA, 601 bp, Human
gaatgctagaatagctgatgcttttagaaatcaaatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcaacagaggaagcagagccctccaagtttatatgagattgattactccaragctttgactagagacctgttcttgtagaagccagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcacatagttttaaatgattgcaagatatatttgattctaggtcttttcaga

SEQ ID NO: 205722 - DNA, 601 bp, Human
aatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcaacagaggaagcagagccctccaagtttatatgagattgattactccaaagctttgactagagacctgttcttgtagaagcmagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcacatagttttaaatgattgcaagatatatttgattctaggtcttttcagaagtttagcattgaatctttttcaaaattttctc

SEQ ID NO: 205723 - DNA, 601 bp, Human
caggagtgagcaggtgggcatgatgagggagatgctgggggtcccaaggtgaggaaggaaaagagcaaatggccttctggtgcacgtggtcattaaggtgagatgactagtgagaagccttgagtcttgatgaatgggcgagggagacaatcctttatatcaagtcccaggaactaacttgagagcccaatgtggagggcactggaaagtcagttaaacagttagatagtcccacctgctgaggagatggaagcaagggccaaatcgcagggtgggggtcaggttggcctagagccctctrtgcgatgagaagcttgaaacccatctctcagtatgtgcagccactggagctggggtacagctggggtcttggtgagtcctaagtgactgttcagattaggtcacaacagactgaggtatttgtctttaattcaggaagcaagagcattgagagctcttgttcacattttacctgcagctgattcaatatcctgtctgactcttcaggtggtgttttaccaaattatgtcctggaagaggccagtccatattccagaagttagaccagatgctaatatgctctgcagctggctggaggagg

SEQ ID NO: 205724 - DNA, 601 bp, Human
gggtcatataccacgtgatggggagagaagagggaggcagaggacacagtccagcctggagcagacatggagtcaaaggctgatcttggctcttggaagatcctggggggagattgaggtaggacaggtgtgtcacaggggcttctgggcagcattcagctctggggtgctcacaaagtgtggtggctgctggaaatagtgacctatgcctctcattagagtatttcagctgaaagggcctttggaatcttctcttctcccagggtaggaaatagaaactcaacaaaggtgatgactcagyattgtcaggcagctagcccatagcagggactagaccagaaccctggccttttcacttttcagagttcttttagaaacagttgaattgggctgtaagtgatctatattaaagtacatattttaaagtgaacagtatacgttttgacataggtagacactgtaaagccctcaccacagtcaagataatgagcagatccattccccaaaaaaagttacctcgcatgccttcatcattcctccccctgccttcctcaccccgcaggcctggtgcccaggcaacctctgatctgcttcctgtcat

SEQ ID NO: 205725 - DNA, 601 bp, Human
cctcaccacagtcaagataatgagcagatccattccccaaaaaaagttacctcgcatgccttcatcattcctccccctgccttcctcaccccgcaggcctggtgcccaggcaacctctgatctgcttcctgtcatgacaggtgtgtttgcattttgtagaatttttttctggaatcacacagatttctttttgtgcctggcttctttgattccacctgttttgagatgcatccatgttctcggatcagcagttcactcctttttcctgctgaatgatattctcttgtatggatgaagcatscttttccctgctgatgaacagtcaggttgttttcagtttggggctgttacaaataatgctgccatcaatattcatgtaccagtgtttgtgtgggtgtgtcatttcatttctcttacattaatacctagaaatggaatgaccaggacctgtggtaggtttatgtttaactttttaagaaatttccaaactgttttctggagtagttgtaccattttatattcccatcagcagtgtacgagggttccagtttcttcacttgctcattagcagttggtatggccagtctttttacttctagtg

SEQ ID NO: 205726 - DNA, 601 bp, Human
gtaccagtgtttgtgtgggtgtgtcatttcatttctcttacattaatacctagaaatggaatgaccaggacctgtggtaggtttatgtttaactttttaagaaatttccaaactgttttctggagtagttgtaccattttatattcccatcagcagtgtacgagggttccagtttcttcacttgctcattagcagttggtatggccagtctttttacttctagtgattgtaacaggtgtgtagccgtatcctactgtgtttttcacttgcattttcctgacgaccgaattatattattttstcatgaacttacttgccatgtgtatgtctttcataaattgtctgttcaaatctcttatgtatgctttttattgggttattttctcattgtaattttgacagctcttgatatattctggaaacaagtcctttatcagacataatgatttgcaaatattttatctgagtctgtggcttgtcttagcattctcttaacagtgttttttgaaaagtagaacttctaaatttcgatgagatccagtctatcggtttttttttttatggatgaaacttttgtgtcatatctaagaactatttgtct

SEQ ID NO: 205727 - DNA, 601 bp, Human
ttccaaactgttttctggagtagttgtaccattttatattcccatcagcagtgtacgagggttccagtttcttcacttgctcattagcagttggtatggccagtctttttacttctagtgattgtaacaggtgtgtagccgtatcctactgtgtttttcacttgcattttcctgacgaccgaattatattattttgtcatgaacttacttgccatgtgtatgtctttcataaattgtctgttcaaatctcttatgtatgctttttattgggttattttctcattgtaattttgacagctcytgatatattctggaaacaagtcctttatcagacataatgatttgcaaatattttatctgagtctgtggcttgtcttagcattctcttaacagtgttttttgaaaagtagaacttctaaatttcgatgagatccagtctatcggtttttttttttatggatgaaacttttgtgtcatatctaagaactatttgtctaacacaaatattttctcttattttttcagaaattgtatagtttaagatgtacatttaagtctgcaatccattttgattaatttttatatatagtgcaagtcattt

SEQ ID NO: 205728 - DNA, 601 bp, Human
tagaacttctaaatttcgatgagatccagtctatcggtttttttttttatggatgaaacttttgtgtcatatctaagaactatttgtctaacacaaatattttctcttattttttcagaaattgtatagtttaagatgtacatttaagtctgcaatccattttgattaatttttatatatagtgcaagtcatttgacacgtgtgtaatatagcaaaaggcacatattggatctgtggattaaggtcactttacccaccgatggtgacagaagtcttctaccagtactgtcatattaaaatscaaaggtcaatcatacattatatatgtacatcactcaataaacccctaaagtacattgcccagttttcataatacatttaatgaaagaataataaggtcattaagggcaatcagtgttttgttatattcctgattatattcttgattatagtttgttgcatttctcgaacgaacatggatggagcaagaagtattcctcttccccctttaatgcgaaccaacatagtctcagactccagtttaaaaccttgtcaacagcagtgattgcacattgtttaccccacccgctcccggttgtag

SEQ ID NO: 205729 - DNA, 601 bp, Human
agtcacttagtctctcccgacaccaatttcgctatctgccagaaggggaagagtatccttctggtgtacccaagtggattcagtgagaggacatgctctccatgtacataatgggccaaaggtcatgcattttttcattttatgtggaaaaaatgacttgcacgtgttcgtttgggaggcaccatgaaaactggctttaccttctctagggaccttccctaaccccatcccagaccctgaggcggggttgccacattcattccccttgcatatttccctcattgcatgtcctgcgtcacartgatggctttgctccctgctgtgagagcaggaatttcttcagggccaagacctgtaatttttatttataactctagtgccatttcataagcatttgatgaataaacaactaaatgaatacatatgaagatgagcagagcagtcctggtgttgaaggaattcataacctggtggaggagatggacacgtgtgtgaataattgcagcacaccgttctagctataacaagcagtttattcacttttaaacaaaatgggaacgcttctttctcatctaataaaattgcttctgtgggcactcca

SEQ ID NO: 205730 - DNA, 601 bp, Human
cccgacaccaatttcgctatctgccagaaggggaagagtatccttctggtgtacccaagtggattcagtgagaggacatgctctccatgtacataatgggccaaaggtcatgcattttttcattttatgtggaaaaaatgacttgcacgtgttcgtttgggaggcaccatgaaaactggctttaccttctctagggaccttccctaaccccatcccagaccctgaggcggggttgccacattcattccccttgcatatttccctcattgcatgtcctgcgtcacaatgatggctttgctcmctgctgtgagagcaggaatttcttcagggccaagacctgtaatttttatttataactctagtgccatttcataagcatttgatgaataaacaactaaatgaatacatatgaagatgagcagagcagtcctggtgttgaaggaattcataacctggtggaggagatggacacgtgtgtgaataattgcagcacaccgttctagctataacaagcagtttattcacttttaaacaaaatgggaacgcttctttctcatctaataaaattgcttctgtgggcactccagacatttgggtagaa

SEQ ID NO: 205731 - DNA, 601 bp, Human
ggaagagtatccttctggtgtacccaagtggattcagtgagaggacatgctctccatgtacataatgggccaaaggtcatgcattttttcattttatgtggaaaaaatgacttgcacgtgttcgtttgggaggcaccatgaaaactggctttaccttctctagggaccttccctaaccccatcccagaccctgaggcggggttgccacattcattccccttgcatatttccctcattgcatgtcctgcgtcacaatgatggctttgctccctgctgtgagagcaggaatttcttcagggcsaagacctgtaatttttatttataactctagtgccatttcataagcatttgatgaataaacaactaaatgaatacatatgaagatgagcagagcagtcctggtgttgaaggaattcataacctggtggaggagatggacacgtgtgtgaataattgcagcacaccgttctagctataacaagcagtttattcacttttaaacaaaatgggaacgcttctttctcatctaataaaattgcttctgtgggcactccagacatttgggtagaaagtatgttgctgaaaaatgatttctaagaag

SEQ ID NO: 205732 - DNA, 601 bp, Human
cttaatggaatattatcagaaaaatgtgttttatatatctgtctttgaaagttttacttatataccggattctgttacaaataataaaataaagttctgcttattggtagctatttctgtttcaagttaatgcacagagccacaaaatgccatacaaaagaaaggcaacatgatgtcctttggctgaaggcttcatttctattcgttttccatagaaattatgtgtgtctgcttttgaagaagcatactgaaaaaaaaaaaaaactatcctctactaggtgccttatttgtgtaatagaarttctaatccaagtttagtaatacaaagaaagagagttttgcagatggaagactgccagcttgacagcagtcatgcccaggatgctcataaggactgctagaggagggaggtcaccaggagccagcacagggccactgaaaccacgtcagagcagctggagttccacacgttggtgaggggtgaaggagaggggaattaagtgttatccaggtggatgtacctgaggttctgtgatttcataagcattcataacgagtattgacacaatattcatcattagctcattcacatcagacccta

SEQ ID NO: 205733 - DNA, 601 bp, Human
catttagcaattatgtataaaaatattgagggctgaaatgatgtgagatttgctttaaaatactacaaaataaaggaaaaaggaagaaagaagaaagattgatggcgtacatgtgttgaaatgttagtaattgttgcatctggagagcgggtggataagtggggtttattttactatttttgcttttgtatatgtttgaaaactttcgtcgtaaaaattcttcataaccatctttctagaaattatgcagattgtaaaatataagtaaatagtgacataatttgaggcatggattactatrcatcttatatgcaagaaacacctgcccgtaaattcaattaaaaattgttttatctctacaaaaaattccgatttatcagacagtcaatttgcattacaaagggcactgtttcttttataaaatagtttgctgtagaattccattaaatgatttatgtaatttccatgggtagtctttttttttttttttggagatggacttttgctcttgttgcccaggctggagtacagtggcgcgatcttggctcaccgcaacctcggcctcctgggttcaagtgactctcttgcctcagcctctcaa

SEQ ID NO: 205734 - DNA, 601 bp, Human
atatgtttgaaaactttcgtcgtaaaaattcttcataaccatctttctagaaattatgcagattgtaaaatataagtaaatagtgacataatttgaggcatggattactatacatcttatatgcaagaaacacctgcccgtaaattcaattaaaaattgttttatctctacaaaaaattccgatttatcagacagtcaatttgcattacaaagggcactgtttcttttataaaatagtttgctgtagaattccattaaatgatttatgtaatttccatgggtagtctttttttttttttttggagatggacttttgctcttgttgcccaggctggagtacagtggcgcgatcttggctcaccgcaacctcggcctcctgggttcaagtgactctcttgcctcagcctctcaagtagctgggattataggcacgtgctaccacgcccagctaattttgtatttttagtaaagacagagttggtcaggctggtctcgaactctcaacctaaggtgacccgcacacctcgacctcccaaagtgctgggattacaggcgtgagccactgtgcccggccaggtactcttttttaaaaatcctccaa

SEQ ID NO: 205735 - DNA, 601 bp, Human
tgtaatttcatcttttgtaaaatggggaaaatagttttctatcccacaatattcttttaggattaaatgaattactgttcataaagtacttggtatgtaataagagtcatgtaagttttataatcatgagaacagtgataattattaatatcacaattatcagtgatagaaagttagctttcttatgcaacctcccaccatctcacttcttctcattctttctctataattgtatcaaaacttttcagtaaatcaacactgtttaccttatgctatgtttatgttatgttattgtggctcwgtgaatgtgttctcaactgaagtcgataaatacactgttagggctacttttcaggcaacacaaactattccaattacttcaagcagaacctgagaaagagaattggaggcttacattatgatcctcgagccaacagtgggatttggcagcttcctatctgcggatgaggcagcagctatcctaagaggtctacctgagcctagagagaggcagctgcgttataggaggtgaggataggagagagttgtaccctgcaggggcctggtgaaggaagcctctgggaaccaggaagggagaagc

SEQ ID NO: 205736 - DNA, 601 bp, Human
tccaattacttcaagcagaacctgagaaagagaattggaggcttacattatgatcctcgagccaacagtgggatttggcagcttcctatctgcggatgaggcagcagctatcctaagaggtctacctgagcctagagagaggcagctgcgttataggaggtgaggataggagagagttgtaccctgcaggggcctggtgaaggaagcctctgggaaccaggaagggagaagccccttcttcctcatgtgtccctccggcgccctctactgacaggggttagcatcaaggcatctggcaaasgacgcaatttacaaggcccagtgctattatcacagagcagagaaagaagggtaggtttggagcagagttaataactggaactcctgttacattcaaacttctaacatgctagtgtagttaaattccagacagtatgtaaaaggcttgggtatgtatggtgggccaggggagcaggtccattgttttcaaatatttgaaaaacagctgcctgagggagggaagacatcattagtatgtgtttctcagagggaccaagaccagggacagttatgggaaagcagatgttggcatcccatgagg

SEQ ID NO: 205737 - DNA, 601 bp, Human
gggcctggtgaaggaagcctctgggaaccaggaagggagaagccccttcttcctcatgtgtccctccggcgccctctactgacaggggttagcatcaaggcatctggcaaaggacgcaatttacaaggcccagtgctattatcacagagcagagaaagaagggtaggtttggagcagagttaataactggaactcctgttacattcaaacttctaacatgctagtgtagttaaattccagacagtatgtaaaaggcttgggtatgtatggtgggccaggggagcaggtccattgttttcaratatttgaaaaacagctgcctgagggagggaagacatcattagtatgtgtttctcagagggaccaagaccagggacagttatgggaaagcagatgttggcatcccatgagggttttggatgcttcactccaaatgtcaccattatcctgacactaagagtgatgaagctgaggctagggtgatcctcagtcattttgcggaagttcagctgggataggaggcagaagtgggtgattcccaaggtccattccaatctggagaagttatggacttttcagacatacctgtgttacctaaagt

SEQ ID NO: 205738 - DNA, 601 bp, Human
atccaccatcatccattcagccatctgtccatccactcatctaaccattcatccatccatccacccatccacccactcacctgttcaaccaagcaaccatccatctacccacccattcagccaaccaaccgtctatccgtccatccaaccattcgtctatcttcttttgagttgctttaaaactcagtaaagttatttcactcaattaaactaatattatttggaacagtgtttattggttggcttccaaggactatatatgatattaatattggaattaatcaaggacatgacgtgcaartgcattattttcatcagtttagatatgagaataattcttatttgctgcctttcatattccaggtgtccttttttctgaaaatttctcataatgtgccaaagaagataagagtaatgtgagcaaagttactgaataaaaccacatatgaccaaagcattgaaatgagaaaacagaacatgttttcatccccgtgattgcaagataattccatacgatcaagtttgaagtttcagaaatcttaaggaacagctctctaagcagaagagcttaaatgattatctgggtcttctatgactcccc

SEQ ID NO: 205739 - DNA, 601 bp, Human
ggcatctcccaatggattaggaaatgtgtaagtacaaggagatgccatgagaaacttgcagtcggtcgactctgtcacttataagctgtgtgacacaaaacaggaaacctcagtacaatccatgaaaaaagcagggcccagagattaacatggattcctcaacatcacacagacaaagagttgcacatctagggttggaaatgacgcctcttgacccacaatctggaactcgtttgtttttaacctacttttttagttttgttccatagaaaatcattaattgctcatgaaaagtgaaatygcactgctgaaaacctgtcctctggtactgggggtttaagttccttctgttgctccaacactggctggtgtttacacactggtgcctgggcaggcctctcgctccgtgtctgggcttcctggtggtcactgcagcggtcgttactgtgggggaaacaggcgacacatgtagggtgacctccgtggtggtggctactctgtttctttatagacaagttacctttctctaatcagcagtccacagcagtggctccctgactgtgcctcctggagcagctgtttggggctcagtggccgagca

SEQ ID NO: 205740 - DNA, 601 bp, Human
ccttcgggtctctgtctgggccatctgctgcataaatccctttacaacacaagaggcagcatacttgctcttgacctggttctgtcactgtggaattggaccacctgccatcacaagtagatccagcaaatgtaccgtggctcgcacatgcacaggttgacttcttgttcatgtaacaaccaaaaacacacttcggtgggtggctttcctcacgtggcaattcagggggccatacagctttccttctgtggctctgctatctcccataaccccattgaaatctacatccagcccatcagayggacggagagcacatggagtgggcacacctatggcctgtaggccttggctcagctatggtgcacctcacgtctgctcacattcttgggagacctcacctgcatggccacactaactgtgagagaacctaggaaatggaatttttagagatgagagatagagctctacctccctgtggtgacatggtaactcctagaagaaagggcagaaatggttagtatttgtgagtacagccctttactgaacttcagaagttttagacagtcttttaaagttgatttcaaaggacctgggcatctct

SEQ ID NO: 205741 - DNA, 601 bp, Human
ttcctcacgtggcaattcagggggccatacagctttccttctgtggctctgctatctcccataaccccattgaaatctacatccagcccatcagatggacggagagcacatggagtgggcacacctatggcctgtaggccttggctcagctatggtgcacctcacgtctgctcacattcttgggagacctcacctgcatggccacactaactgtgagagaacctaggaaatggaatttttagagatgagagatagagctctacctccctgtggtgacatggtaactcctagaagaaagggmagaaatggttagtatttgtgagtacagccctttactgaacttcagaagttttagacagtcttttaaagttgatttcaaaggacctgggcatctctacattcccgtcagactaatttgacttgtggcttggtctttcaaagatttttggagctgtaagtcttactggcaccatgtaggtggtagtcaggacagttctgctagtctcattgagcatgcctagtaactggaatagatttttgccttacagtagaattgaaaaaaaattgccccgtgatggttatttttacaaaggtcatttag

SEQ ID NO: 205742 - DNA, 601 bp, Human
catcagatggacggagagcacatggagtgggcacacctatggcctgtaggccttggctcagctatggtgcacctcacgtctgctcacattcttgggagacctcacctgcatggccacactaactgtgagagaacctaggaaatggaatttttagagatgagagatagagctctacctccctgtggtgacatggtaactcctagaagaaagggcagaaatggttagtatttgtgagtacagccctttactgaacttcagaagttttagacagtcttttaaagttgatttcaaaggacctggrcatctctacattcccgtcagactaatttgacttgtggcttggtctttcaaagatttttggagctgtaagtcttactggcaccatgtaggtggtagtcaggacagttctgctagtctcattgagcatgcctagtaactggaatagatttttgccttacagtagaattgaaaaaaaattgccccgtgatggttatttttacaaaggtcatttaggtcattgattatctgggcatcatgcagttgttttcttgttgtttcctaccataatttttaccaggctctgctactaaatggctgcatg

SEQ ID NO: 205743 - DNA, 601 bp, Human
tcttactggcaccatgtaggtggtagtcaggacagttctgctagtctcattgagcatgcctagtaactggaatagatttttgccttacagtagaattgaaaaaaaattgccccgtgatggttatttttacaaaggtcatttaggtcattgattatctgggcatcatgcagttgttttcttgttgtttcctaccataatttttaccaggctctgctactaaatggctgcatgatcttgcgtatctgctggagcctctgtctcttcattagtaaaagtagggaatgtaattcttaccttgttsggtggggtgatgattaaagcgtgcattgcgtgtcttccatgtagccactcagcataactttgttaaggaaattaattaatacagagtagctgactctccagacatatgtaatgggtgaaaatagggtggagtttggacattgattttagaaacacattctcagagttttaagaaatcagcaatatcaaagctaattccctttgacaactcaactttgtctaagagataacaactccctttggcatctcatctttggggcagcgttttctgatcctacaagtttgagtttgattgtcatcc

SEQ ID NO: 205744 - DNA, 601 bp, Human
acatatgtaatgggtgaaaatagggtggagtttggacattgattttagaaacacattctcagagttttaagaaatcagcaatatcaaagctaattccctttgacaactcaactttgtctaagagataacaactccctttggcatctcatctttggggcagcgttttctgatcctacaagtttgagtttgattgtcatcctcccaccctaccccccacacgccttctctgtatgactggtttacgtctctgactctcccgttatatcaaaaacttttttccccatatgcatccccacccctmgcaaggttgaaatgcacaaaattgccatttaagtagttaaaaaatggttgagtattaacagtttcatttggttgaagctaatacctagaaggcacaagatattttgtgagctattgagcaacgtctgacacctgaatgtagcgtccatgctgctcttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatg

SEQ ID NO: 205745 - DNA, 601 bp, Human
atcaaagctaattccctttgacaactcaactttgtctaagagataacaactccctttggcatctcatctttggggcagcgttttctgatcctacaagtttgagtttgattgtcatcctcccaccctaccccccacacgccttctctgtatgactggtttacgtctctgactctcccgttatatcaaaaacttttttccccatatgcatccccacccctcgcaaggttgaaatgcacaaaattgccatttaagtagttaaaaaatggttgagtattaacagtttcatttggttgaagctaayacctagaaggcacaagatattttgtgagctattgagcaacgtctgacacctgaatgtagcgtccatgctgctcttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatgtggcaaatctgtttcttggatattctgttgaatttacctctaaagacaactaggcctgatattttccttttggaaaacatgt

SEQ ID NO: 205746 - DNA, 601 bp, Human
ttgtctaagagataacaactccctttggcatctcatctttggggcagcgttttctgatcctacaagtttgagtttgattgtcatcctcccaccctaccccccacacgccttctctgtatgactggtttacgtctctgactctcccgttatatcaaaaacttttttccccatatgcatccccacccctcgcaaggttgaaatgcacaaaattgccatttaagtagttaaaaaatggttgagtattaacagtttcatttggttgaagctaatacctagaaggcacaagatattttgtgagctwttgagcaacgtctgacacctgaatgtagcgtccatgctgctcttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatgtggcaaatctgtttcttggatattctgttgaatttacctctaaagacaactaggcctgatattttccttttggaaaacatgtttttaacttacaatccattttctaaaatagt

SEQ ID NO: 205747 - DNA, 601 bp, Human
cttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatgtggcaaatctgtttcttggatattctgttgaatttacctctaaagacaactaggcctgatattttccttttggaaaacatgtttttaacttacaatccattttctaaaatagttattaaagatagtgcagccttgctttttcttctttctgggcsaactttgggaagttatatttttctaagaaatttttgacgtgaagtttttgcagtgtttttcttatctttttaggctttactgaatctgtagttatggcccccttttatttgtgatataatttatttgtgctttctttttttttctgatcaatttttttgccttcgtgaacctttctataaagtgttctatgcttcattaacttttgcccccctcttttagttccatccttcaaataccttcgtatagttgtcattctctttttaacttattttgttgatattttttactttttgctcctt

SEQ ID NO: 205748 - DNA, 601 bp, Human
aatttttgacgtgaagtttttgcagtgtttttcttatctttttaggctttactgaatctgtagttatggcccccttttatttgtgatataatttatttgtgctttctttttttttctgatcaatttttttgccttcgtgaacctttctataaagtgttctatgcttcattaacttttgcccccctcttttagttccatccttcaaataccttcgtatagttgtcattctctttttaacttattttgttgatattttttactttttgctcctttctaataattaattcaattcaagttataratttctattgctgtatcccaatcgttttgatagtagcagctccattataattcattttaaagattttaacattgtaattgtgatttttcctgtttgagttatttaaagttacctttttgatagtgatgtctaatagtcttaagctagacaacttaaaaaatatttgtaaccctcatacactgctggtatgaagggaaaatcgtgtagtcactttggaaaccagtgtggcagttccttaaaaggttaaacatagggttagtctatgactcagcaattctactcttaggtatatacccaaga

SEQ ID NO: 205749 - DNA, 601 bp, Human
ttttagttccatccttcaaataccttcgtatagttgtcattctctttttaacttattttgttgatattttttactttttgctcctttctaataattaattcaattcaagttataaatttctattgctgtatcccaatcgttttgatagtagcagctccattataattcattttaaagattttaacattgtaattgtgatttttcctgtttgagttatttaaagttacctttttgatagtgatgtctaatagtcttaagctagacaacttaaaaaatatttgtaaccctcatacactgctgstatgaagggaaaatcgtgtagtcactttggaaaccagtgtggcagttccttaaaaggttaaacatagggttagtctatgactcagcaattctactcttaggtatatacccaagagtcatgacaacctgtgtccatacaaaagcctgtacacaaatatttatagcagcattatttgactattcataatagccataaagtggaaacaacccaaacgcgcatcagcgtgtgaatgggtaaataaaataaggtatacacgtacaacagcgtgaactactaatgcacacaacaacatggtcgata

SEQ ID NO: 205750 - DNA, 601 bp, Human
tagtctatgactcagcaattctactcttaggtatatacccaagagtcatgacaacctgtgtccatacaaaagcctgtacacaaatatttatagcagcattatttgactattcataatagccataaagtggaaacaacccaaacgcgcatcagcgtgtgaatgggtaaataaaataaggtatacacgtacaacagcgtgaactactaatgcacacaacaacatggtcgatattgaaaatgtgctacatgaaagaatccactcgcaaaaaaccatagagtgtatgattctatttatttgaaaygtccagaatagggaaagctgtagagacagaaataagacacattagtcattagcttggacgggggagatggtgggtttgggaatgatagctaaagtgtatggagtctctttttggagtgataaaaatgttttaaaattgattgtggtaatgattacccaactgtgaatatactaaaaaccactgagttatatttaaataggtggattgtatagtatgtgaatttcatctcagtaaagctggttgttaccagagaaaaaagcattttctaccaaaatcaccaataaattatgatagctctaa

SEQ ID NO: 205751 - DNA, 601 bp, Human
tttatagcagcattatttgactattcataatagccataaagtggaaacaacccaaacgcgcatcagcgtgtgaatgggtaaataaaataaggtatacacgtacaacagcgtgaactactaatgcacacaacaacatggtcgatattgaaaatgtgctacatgaaagaatccactcgcaaaaaaccatagagtgtatgattctatttatttgaaacgtccagaatagggaaagctgtagagacagaaataagacacattagtcattagcttggacgggggagatggtgggtttgggaatgakagctaaagtgtatggagtctctttttggagtgataaaaatgttttaaaattgattgtggtaatgattacccaactgtgaatatactaaaaaccactgagttatatttaaataggtggattgtatagtatgtgaatttcatctcagtaaagctggttgttaccagagaaaaaagcattttctaccaaaatcaccaataaattatgatagctctaaactacttactttaaatttgtttgtgctgattcttactctctctcacctctccctctctgccattctcctggacttctccccatcgt

SEQ ID NO: 205752 - DNA, 601 bp, Human
tattcataatagccataaagtggaaacaacccaaacgcgcatcagcgtgtgaatgggtaaataaaataaggtatacacgtacaacagcgtgaactactaatgcacacaacaacatggtcgatattgaaaatgtgctacatgaaagaatccactcgcaaaaaaccatagagtgtatgattctatttatttgaaacgtccagaatagggaaagctgtagagacagaaataagacacattagtcattagcttggacgggggagatggtgggtttgggaatgatagctaaagtgtatggagtctstttttggagtgataaaaatgttttaaaattgattgtggtaatgattacccaactgtgaatatactaaaaaccactgagttatatttaaataggtggattgtatagtatgtgaatttcatctcagtaaagctggttgttaccagagaaaaaagcattttctaccaaaatcaccaataaattatgatagctctaaactacttactttaaatttgtttgtgctgattcttactctctctcacctctccctctctgccattctcctggacttctccccatcgttggaaatgtcgaataacaaag

SEQ ID NO: 205753 - DNA, 601 bp, Human
agccacgtttctaattatatttttttccctgctttttagataaagggacaaagaaatacggggcttactttgcaggtttttcaggctgctctgaagtgttctttcgaaggtggagggttatagttttgtgtaatagcagtgctgggaacagggtgggttcttccagactctccccccacgtacaatagtgtgtggatggcagagatgcattgggagctgaaataattcatttgtcctttctaatgaatagtaataatttataatttgtactaatcaaaaacctttcatccacaaaagccarcaagttttataaacattctcctctcaccagcctctacagtaagtgcctgacaaaggtaggatcgtccataatttgcagaagggccaagatagagaacacagtgcagaaatcattactaatttatctgcagcttggaatttatatttggaaagtcactttgaacttattttcatcaagctgttttgattgcccagaaatataatttatactgacctccataatggatatctgccaagatgaaagctacaaaagtcattgatccagatgttttctgttatctgcaaacctagcaaagccata

SEQ ID NO: 205754 - DNA, 601 bp, Human
tacaatagtgtgtggatggcagagatgcattgggagctgaaataattcatttgtcctttctaatgaatagtaataatttataatttgtactaatcaaaaacctttcatccacaaaagccaacaagttttataaacattctcctctcaccagcctctacagtaagtgcctgacaaaggtaggatcgtccataatttgcagaagggccaagatagagaacacagtgcagaaatcattactaatttatctgcagcttggaatttatatttggaaagtcactttgaacttattttcatcaagctrttttgattgcccagaaatataatttatactgacctccataatggatatctgccaagatgaaagctacaaaagtcattgatccagatgttttctgttatctgcaaacctagcaaagccatatttgccagcatagtcgacattgtggggacaggtgtccattctgtgtccccttggtgtccagccctattatctctgtagcctccggtgacagagcagccatagtggcactgtgcttgatgcaaagataccattaccttctcgtctgttctctgatcagtgagtggtggcgatatgagctga

SEQ ID NO: 205755 - DNA, 601 bp, Human
tgtgtggatggcagagatgcattgggagctgaaataattcatttgtcctttctaatgaatagtaataatttataatttgtactaatcaaaaacctttcatccacaaaagccaacaagttttataaacattctcctctcaccagcctctacagtaagtgcctgacaaaggtaggatcgtccataatttgcagaagggccaagatagagaacacagtgcagaaatcattactaatttatctgcagcttggaatttatatttggaaagtcactttgaacttattttcatcaagctgttttgatygcccagaaatataatttatactgacctccataatggatatctgccaagatgaaagctacaaaagtcattgatccagatgttttctgttatctgcaaacctagcaaagccatatttgccagcatagtcgacattgtggggacaggtgtccattctgtgtccccttggtgtccagccctattatctctgtagcctccggtgacagagcagccatagtggcactgtgcttgatgcaaagataccattaccttctcgtctgttctctgatcagtgagtggtggcgatatgagctgagcataaag

SEQ ID NO: 205756 - DNA, 601 bp, Human
gtcgacattgtggggacaggtgtccattctgtgtccccttggtgtccagccctattatctctgtagcctccggtgacagagcagccatagtggcactgtgcttgatgcaaagataccattaccttctcgtctgttctctgatcagtgagtggtggcgatatgagctgagcataaagcaggaagagtggggatgcccttgtattcagtatacctccagaccttatcactaccaagtgtccaacacagggctgctaagtaatcttgaaaatataccttccactcttatcagtgcaccttcttracaccaaatctgtattcttgatcctggaattcagaattctccatcaaaaacattgaaaagcaggttacttcatcagctctcctctatatactgtgttgaggaaaagatttgcatgtaattagcctccttccacctccctccagaaaaaccccccaaatttagagaccagtcctaacccttagaaaatgcatagtgttgcagactgcttttgaagattaaagagatgaaaattccattcttaacttcaagagcttccttaaacctggtccaaaagactttcctaaaagcccagccagttca

SEQ ID NO: 205757 - DNA, 601 bp, Human
ttagcctccttccacctccctccagaaaaaccccccaaatttagagaccagtcctaacccttagaaaatgcatagtgttgcagactgcttttgaagattaaagagatgaaaattccattcttaacttcaagagcttccttaaacctggtccaaaagactttcctaaaagcccagccagttcagatgataggtgcagacacatcatattgcatatattcacattacacacacacacacacacacacacacacacacactctcacccttctctttgctggggaaaggtttgttgcagaagttrccattccaatacaccatgcaagatgcattcagacgttctcttagatttcagtatcacacggtggatcctgcattttgtcatataaaaattgcacatcatttttagctgccttcagaaccctcttcatatttattaggagtattgtgctcctatccagcagctaaagctgcttcgtgttgtccagttagggtgaactatagaagaaatgtcctatctactgcttttcttttttaaaaaaatttttatttccttaagttttgggggaacaggtggtatttggttacatgagtgcattcttta

SEQ ID NO: 205758 - DNA, 601 bp, Human
tgaagattaaagagatgaaaattccattcttaacttcaagagcttccttaaacctggtccaaaagactttcctaaaagcccagccagttcagatgataggtgcagacacatcatattgcatatattcacattacacacacacacacacacacacacacacacacactctcacccttctctttgctggggaaaggtttgttgcagaagttaccattccaatacaccatgcaagatgcattcagacgttctcttagatttcagtatcacacggtggatcctgcattttgtcatataaaaattrcacatcatttttagctgccttcagaaccctcttcatatttattaggagtattgtgctcctatccagcagctaaagctgcttcgtgttgtccagttagggtgaactatagaagaaatgtcctatctactgcttttcttttttaaaaaaatttttatttccttaagttttgggggaacaggtggtatttggttacatgagtgcattctttagtggtgatttgtgagattttgttgcacccatcacccaagcactatacactgaaccgaatttgtagtattttatctctcacccccttcctcc

SEQ ID NO: 205759 - DNA, 601 bp, Human
tcctaaaagcccagccagttcagatgataggtgcagacacatcatattgcatatattcacattacacacacacacacacacacacacacacacacactctcacccttctctttgctggggaaaggtttgttgcagaagttaccattccaatacaccatgcaagatgcattcagacgttctcttagatttcagtatcacacggtggatcctgcattttgtcatataaaaattgcacatcatttttagctgccttcagaaccctcttcatatttattaggagtattgtgctcctatccagcarctaaagctgcttcgtgttgtccagttagggtgaactatagaagaaatgtcctatctactgcttttcttttttaaaaaaatttttatttccttaagttttgggggaacaggtggtatttggttacatgagtgcattctttagtggtgatttgtgagattttgttgcacccatcacccaagcactatacactgaaccgaatttgtagtattttatctctcacccccttcctcctctttccccctgagtccccaaaagtccattttgtcattcttatgcctttgcatcctcatagcttagctc

SEQ ID NO: 205760 - DNA, 601 bp, Human
ctcctcacctcaagtgaaccacttgccttggcctcccaaagtgctgggattacaggcatgagccaacatgcccggcacggaatgaatcattttttgaaaaggtttacagaaacctttaaaaaagaaaacttaaataaatgtacgttattgtgccaaacattggattcatgtccattatctctcctttgacctagagtcccctccctacttggagtggctcctcatcttccttctttagcacagtgtggaggtaggagtgaagattctggagctacattatggaggtctgggttctgactcygcccctcagtggtggtgtgatggtggctgtgccatgtaacctctctgtgcctaactgtcctcatctgtaaaatggatataatgaaaatagctcttattggcttgatgggagaattagttgagttagtatatgtaaaccacttatagttgtgcctcatccagaacaagcactgtttgccactattattatcaaatgatctctagttttgcatcttcaaaatctagtgagaatttaaagacattcgtgtagcaacttgaacaaagaatttatctagattttcatgacttcctccccaatctt

SEQ ID NO: 205761 - DNA, 601 bp, Human
gatataatgaaaatagctcttattggcttgatgggagaattagttgagttagtatatgtaaaccacttatagttgtgcctcatccagaacaagcactgtttgccactattattatcaaatgatctctagttttgcatcttcaaaatctagtgagaatttaaagacattcgtgtagcaacttgaacaaagaatttatctagattttcatgacttcctccccaatctttttttctttaaaaaaaaaaaaaagctggaaaaatacacataacataaaaattactaacagccatttttaagtgtrttgttcagcagtatggagcccattcccttcgtcgtgcagtcatcaccaccatccactcctcgagctctcttcatcttgtaaaaccaaaactctgtgaccattcaccaccaattctgcatccgccttctccgagcccttgacagccacccttcccaatcttacggagtagtcttgcctgcatttaatttgacagtatttttaacaactttcttttattaagctttctaaagcatttcccttattttttattttttggttttgttattttcatttgacacctaaaaatggtacctatttatg

SEQ ID NO: 205762 - DNA, 601 bp, Human
ctttctggtgctgttctcatgatagtgaataagtctcacgagatctcatggttataaaaaggggagtttccctgcacaagcactcctctctttgcctgctgccgccgccatccatgtaagatgtgacttgctcctccttgcctcccactgtgattttgaggcttccccagccatgtggaactgtaagtaggataaacctctttattttgtaagttgcccagtcttgggtatgtctttaccagcagcatgaaaacagactaatacaaacatccagttagatatactgtctccattaaaccaragcacttgtctgtgcccctcccatggcacctaacactttctatcctgtgttttcagtgtttgggtgagttctccaagagcaggctcagtgtatcacatgtctttggatgtctcctatcattggcttcaagccaagattgaaggctcacatgtattgaattcctggcctgtccggctgggacagagagaatgagtagagaaactaagtatcagcacactttatagttaaagcctgtgtgtacgcacatgtgtgtgcacacacgtgtataatgtaatctttatagcgtacctttttggcgtt

SEQ ID NO: 205763 - DNA, 601 bp, Human
tcctgtggttgtgatgttggattacgagccccatacaaaagtgaaaatgaggctggaattatagttggtttggtcaccattttgattgtactgatatttgattgaatcagactactgtttttcaggctttaaaaaaattatagtcgccctaagcggcctttttagacatttctctcttgtctcccccagtccccttccattaaatttaataccacagatatactatataccactagttactgtggccctttagaagccgtagccattttcatatgtaagatatttttgtcccccaagaacygatttttgcccccttgaagtgacaccacccttattgagaaatcataatttatagaatcaggtggtttggtgctgtgcagatattctaaagagttcctatttgatatgtacatagtcgattataaagttcttaagcctcagttgcttgttgtgttggcatgcttttaagataaagctgttggactgattttttttggggggctgtggtgtaaaataactgatgcttttggcactgtctaggaggcaaggccaagactttcctcagaccagcaacagtgtttcagtgtgggtctgagttata

SEQ ID NO: 205764 - DNA, 601 bp, Human
atttatcctttgtgttacagacaatccatttattttcttttagttattttgaaatgtacagttaaattattgactatagtcaccctgttgtgctatcaaatggtatggagtgccttttctcatccatcgcatggagagtttagaacagtttttgaagaatatgaaaacatattggacttgatttcaaagaccccttctattatcatgctcgtagggcctctctagttgtcttttaactctgaggtggaacacagacacttttaggaaaacgtacgcttgacaacttacccagagaaacctrtctttgcttggagagccgtccatgttgttctgtttgtactaacatagatcctaaacatttgaagtcttctggcatctcattgtgaagttctgcgatgccatggttgatcattattagtatatggagttataagatttgattaccactggtaagttcccaaagtgctttgtgctttcccctttatgtctgttattgctcttaaccatcttctaagattgataggacagatattagtatgcccattttatagatgagcagcctgtggctaagagaagttaagtggcctctctagcagattat

SEQ ID NO: 205765 - DNA, 601 bp, Human
tatcaaatggtatggagtgccttttctcatccatcgcatggagagtttagaacagtttttgaagaatatgaaaacatattggacttgatttcaaagaccccttctattatcatgctcgtagggcctctctagttgtcttttaactctgaggtggaacacagacacttttaggaaaacgtacgcttgacaacttacccagagaaacctgtctttgcttggagagccgtccatgttgttctgtttgtactaacatagatcctaaacatttgaagtcttctggcatctcattgtgaagttctgygatgccatggttgatcattattagtatatggagttataagatttgattaccactggtaagttcccaaagtgctttgtgctttcccctttatgtctgttattgctcttaaccatcttctaagattgataggacagatattagtatgcccattttatagatgagcagcctgtggctaagagaagttaagtggcctctctagcagattatgccctcaaatgtagaaaaactcaatgtggttcttcagactccaaagtcagtgccatttacttgcccgtagtaaatgccttcagccttcttaaa

SEQ ID NO: 205766 - DNA, 601 bp, Human
aaaggatgagggaggttgaagaatggttattatttaatgaaaaaaaattactgtgtctccctctcccctccatcttgcttataggataaataaactaagtcaagtctttttattttaaagatcagtttcttacctggactcggactctaggcagttcccgtggcacaagggttgtttgttgtcaccatcgttacattagtcaccgtggaatcctcagtgctcagcaccgtgcatggagcttagcaggcatttgatcagtatttattaatgaataaataaaatggtgctggcccatacagtraagtattctagtcgcattagctgtgtctaatacctttctctgcatagtagccacatccactttaggatttgtagtgaggtttccgtagaattcagtggttagggacagagggttggagtccagtgtgcatgtgggattccatctagggactggtcattggcaggtgaatggagctggggtccatacagatgccccgtccggatgaaggataagtgagtggtgggcagatgcagcacgagggctcctccggcccgtacgtctttattaacatcacatcacatgcccagtcctggggcctac

SEQ ID NO: 205767 - DNA, 601 bp, Human
tcagtatttattaatgaataaataaaatggtgctggcccatacagtaaagtattctagtcgcattagctgtgtctaatacctttctctgcatagtagccacatccactttaggatttgtagtgaggtttccgtagaattcagtggttagggacagagggttggagtccagtgtgcatgtgggattccatctagggactggtcattggcaggtgaatggagctggggtccatacagatgccccgtccggatgaaggataagtgagtggtgggcagatgcagcacgagggctcctccggcccrtacgtctttattaacatcacatcacatgcccagtcctggggcctacagaggagagccactgtcactaagcacatacttgtaagcactgagcactcacaggttgcaccgcatgggactgatcccaagtagaataagatggggcggcagggccgggtgtggaaggaaacaccactttttgcatctcctctccctgcccttgctgaactctgcctgctccctccaccgtcggtcctcttcacagccacccgctgggggaccccaggggaggtgactcagtggaggagccctgctctgacaaag

SEQ ID NO: 205768 - DNA, 601 bp, Human
attttgcagttaaggaagttaaagcccatagaggaagaagctttgccaaagtcacacagctgctaagtgaccagggtggcaactcgggcactctggctcccaaaccgagttcttgagctctcctctccatgctcctttggtctgggtggtgcccagccatctgtctagataggtatcctgctgactgcaatgtggcagtctatggctggtagggacgtgggggaacagtgtgaccgacctccttgcacagggctgtcattgcactgcgggctacagcagagcccagttcacactggagggscacccactcagctgggctgttttctgaggaaccagttgtttgtcctcccctaaccttctccacagcagcacagagtccaggaaccctgagcaccgggaccagggccggcttgggaggggtgggggcgggggctttgtgcacaggtcttgcctgtgggcctcatttctgtgtctctggtatgagaaaaacctggattgaatagaaagaccttccctgaaactgggaggttgctgagagaccaaagaatgacttggacaagtccagcttggcgatagatgagtttattaggacttacatagc

SEQ ID NO: 205769 - DNA, 601 bp, Human
ctgctaagtgaccagggtggcaactcgggcactctggctcccaaaccgagttcttgagctctcctctccatgctcctttggtctgggtggtgcccagccatctgtctagataggtatcctgctgactgcaatgtggcagtctatggctggtagggacgtgggggaacagtgtgaccgacctccttgcacagggctgtcattgcactgcgggctacagcagagcccagttcacactggagggccacccactcagctgggctgttttctgaggaaccagttgtttgtcctcccctaaccttcyccacagcagcacagagtccaggaaccctgagcaccgggaccagggccggcttgggaggggtgggggcgggggctttgtgcacaggtcttgcctgtgggcctcatttctgtgtctctggtatgagaaaaacctggattgaatagaaagaccttccctgaaactgggaggttgctgagagaccaaagaatgacttggacaagtccagcttggcgatagatgagtttattaggacttacatagcaggcactcctgggcggcaggacagatctagagatccctgctgctcccgtctctaaactg

SEQ ID NO: 205770 - DNA, 601 bp, Human
ggaggcccccttggtccttctagatgagccccacctgggaccccacgcaggccgagctgctcttggttctgacggctctgctcggcctccctcccaaatctcgtctacataagacctgcttccctgctggcgaagcaccaccatttctatggagaacttggggtgtcattctcaactccagtctgagttgccatcatgttccatgatgctggcagcgtgtcccagcctgtggtcacttggcaccccctggagaggtggacttgtactctggatctgcagcccaggcagcagtgggagcctytcctccagctcagccccggtgcctctgccctctcccaggtctcatggactctggtggacaaaggttcttgtcagaggaagtcgttgacagggtgccatgggaaacggcctctccagggaggcaagattccagcctcagctcttgctcctgtagcccctctttcggaggtgtctttctgcctggattaaacacttgctcattaaacctggcttaataagaaactagaaaagaaaaagaattagaaaaattctgattctagactgggtaatcgctttgagaaatgcgatttttcccttttgc

SEQ ID NO: 205771 - DNA, 601 bp, Human
gtgcctctgccctctcccaggtctcatggactctggtggacaaaggttcttgtcagaggaagtcgttgacagggtgccatgggaaacggcctctccagggaggcaagattccagcctcagctcttgctcctgtagcccctctttcggaggtgtctttctgcctggattaaacacttgctcattaaacctggcttaataagaaactagaaaagaaaaagaattagaaaaattctgattctagactgggtaatcgctttgagaaatgcgatttttcccttttgccacttcatcaaaagagtgrgaatctgggcctttctagggtgtggatgaaggctgagctgcagtctccagcagaggaagctcagtgcccagaccagtagtacacacaactgagacttctagaatgaatgaagaatgaatgaatggataaattggagtgaggcacttacagagataaaattcagtttgataagaaggaggcgtccttaaatcttgtgttttctcctagagttgagtcctaatgggggcggcatccttgtacggaaacacgaaaggttaatagcaataacaatagaaacctcgtgtttgtgtatggagagcc

SEQ ID NO: 205772 - DNA, 601 bp, Human
gctgtcatgaaagaagagcctaatcccataaaatattcttgacagcctcgtgtcagttaccacacagctgtgatttcttatctgggctacagcctgtgtgacatttgttgtcacttcatggcttcaggtttctccattcagaagctcaggtcatagtaggaggttgagcttcatccccggttgaaacctggttcgcgtatgactgaatcctcttacgtcctcactgttgtgtgaaaaaactcatagggagaccttgatttcctcatctgtttaatggggaccatatgtctctggcaaaatmgttgtgagcaatgtttgtatgtctgtgttcacagtagcattgtttgcagtggtaaaaaggtagaggcaacccacatgttcgttgatggatgaatggataaacaaacaaaatacacccaatggaatattattcagccctaaaaaggaagaaaattcagacacatgcaacaacatgggtgaaccttgaggacattacgccgagttaagtaagacagtcacaaaaagacaaatagtggattccacttataggaagtccctagagaagtaaaatccacagagacaagaaagtggaaagggggtt

SEQ ID NO: 205773 - DNA, 601 bp, Human
ttgatatttaatgggtacggaatatcagttttgcgagatgaaaagagttctggagccggatgattagtgatgattgcaaaacattgtgaatgtacttaatctgatggtaaattttatgttatgttcattttatcaaaataggaaaaaaatccatgagcattaaatggcatcaagtagataagtggctaccatatcattgttgttcactaaatcataaagtaacagctttgaccatgtgtgggatagtaaaatatgtggtattttaatggttctatgaaacttcatcttatgagtataccaygtttgtttccctttgtttggcttgtgtatttcttataagtattctaccattgtaataatgacagagtgaattttttgtgcatgtatatatcttttctattagttgaagttatacctttgagatggatttcctggatcacttaatcaaggtaaatgagcgtctttgtggctcttgctacatacacccgtggggtttcagaaaagatttagtgattttaccctgtcactagccaagtaagggcaccatttcattgtatcctcaacagcactaagatgcttctaagcaattttattaaatgtg

SEQ ID NO: 205774 - DNA, 601 bp, Human
actagagcaaaagtggttttacaatcacattattatacctactgtatctttttcccaaactctccactgtcattcttttcatatcttttagcataaaatctgtttagatgctaacttgaatgactatagtatttgaattaaaattatatggactagccaattaataataaaatattaatataataataacccagtataaaaggacatgccaattagagcaaagaagaaattaaaattgctaataaccatgaaatttgtgttttacttcactaataatataaattcatcctaaataaaacartagaatcctatcttccagctatgaattgctaaggattaaaaatgttgtaatggtgactgagactggccctcaaaaacgctgccaatggaaagagaaaactgggtcaactttactgaaaagcagtttggagctaggcatcaagaaatttaaaaatgtttagaaacattgatttagaaattccatttatataactaaggcttgaggcagcttcagaagcatggaaaaatatttacatttatggataaaaatatatttcagtctaattgcccaatgacaaggaatgattgaataagtagttgg

SEQ ID NO: 205775 - DNA, 601 bp, Human
cgaactcctgacctcaggtgatgcaccctcctcggcctctcaaagttctaggattacagtgaactgccgtgcccagcttgccaaattctttactacacataaggtgactgaaaacagatagataaaaaatttatatagcctagtgatcttagtatggagggatctcttatttgccatgctctaagactataaaagaaagaaggacatgaatttcacaggtacaagcagtactgcaaatacccacccctgatccaccaaacctccaggaccaccactgagaacaggcctacttacagaggaycctgcaagtagacatatgtcaccatcattgtttaccacagagaagaattaggctgggaaaacacttaccaccctgctgggtatttaaatctgacccttgtcccagtgttaacagcacagcacgtatgtccctccttaactcactgatctcatgtgaacgagtgatcagcctgttttttacaggtttctctccctggcaccatctcactgtggtgcagctgagctcactacatatagcatggagtgatgataaaaataaattggctctttccctttgcagagtttcagttcttgagcgcta

SEQ ID NO: 205776 - DNA, 601 bp, Human
ctttatttctctgagtttagcctttctcgtcttttgacgttatcaggttggatttttttaaaaaaatgtatgtggtgataaagaagaacataaaggtaaaatgcagtattcactaggtccacaaagcttgctcatttaaatatttcatttgttctctttggaatttgttatgtggagatattaatatatttgggctataaacaatggtggttggaaattttatttgaatgcatacacaagtgaaatattccatgttggcaaatatcattgtaatattcaataatgaagcaatttcaagatygcatcccagcagccttgcaggccctgctttgccagtgtgatgatctgatattatgcagcttatgaactgaaaagtcctatgcaatagatgtggtttttcacaaaccctcttcatttggcagtcagtctatttcaccaaagtattttctctttggtgtcagatttttgtgtagtggatatgcagtgttatttcttgatgagtgaagtttttctccaaatgtaaattgtgcttcatggtggaatcttcatatgcctgtagcagcacaggttggtgggtcctgagtgctggttctaagaacca

SEQ ID NO: 205777 - DNA, 601 bp, Human
gaccatctctttccataggtcagtggcctccccacaggtgaggaagaggtaaggaagggcaggggatgatggttagttaagggtagggcgagagatcctccgtcaggaacctctactcagctggctttgtttttcttaagctagttttttagtttctattacatgtaacagtaacaaaaatccttactaatccacccattcaatccaaacaatcttatgcccattatatttgccaggtgcccttttattttttgtttttgttttttattttattatttttttgagactgagtcttaatcckttgctcaagctggagtgcagtggcgtgatcgcgtctcactgaaccctccacctcccaggtgcaagcagttcccctgcctcagcctcctgagtagctgggattacaggtgcatgccaccatacctggctaatttttcatgtttataatagagttggggtttcaccatgttggccaggctggtcttgaacttatgacctcaagtgatccaccctccttggcctcccaaagtgctgggattgcaggcgtgagccactgcgcctagccaccaggtgtactaaatcactaaggcatctgggatac

SEQ ID NO: 205778 - DNA, 601 bp, Human
aggggatgatggttagttaagggtagggcgagagatcctccgtcaggaacctctactcagctggctttgtttttcttaagctagttttttagtttctattacatgtaacagtaacaaaaatccttactaatccacccattcaatccaaacaatcttatgcccattatatttgccaggtgcccttttattttttgtttttgttttttattttattatttttttgagactgagtcttaatcctttgctcaagctggagtgcagtggcgtgatcgcgtctcactgaaccctccacctcccaggygcaagcagttcccctgcctcagcctcctgagtagctgggattacaggtgcatgccaccatacctggctaatttttcatgtttataatagagttggggtttcaccatgttggccaggctggtcttgaacttatgacctcaagtgatccaccctccttggcctcccaaagtgctgggattgcaggcgtgagccactgcgcctagccaccaggtgtactaaatcactaaggcatctgggatacgcacgagtatccggcctcttggttaatgcacatggaaaatatattcctacaggaagaaaa

SEQ ID NO: 205779 - DNA, 601 bp, Human
caaggtcagaatttgaagcctgctcctcgaaggatggaccagaggcaggggagagccaggctacaaatgaacttggctatcactcactcaccacatctgaccacagctgcctaaatctctacttgaggtcacatggcaacctgtcacgtttcacagtaaaagttggtcttgaaaagaaagccgccactagagaagatgagggtggtgaagatatgtaagactgactgttcttactcagaaaatggacattttgaaagagagcagcaggttggatttggtggtgattctgatctgtgaggcmgtagtccactccaggttcttttcagaaacaaaagtgattactaaaactactcgagcaatgctcttgcctgtgccagaattgcttatcaacaaaaagacaaaacttgtgtagaagttgaaaagtcattgacatttgatgtgaagatgcgcccaggaaacatgatttccacagaaatgtgactcaagagaaatgtattttaattagcatgttgaaagattttagtacctttttgtaaagtcattaaggacttgaaggggccttaaatttttttggttataattcactgcattttataggaga

SEQ ID NO: 205780 - DNA, 601 bp, Human
cacaattggcttactgcaacttctgcctcccaagctcaagacatcctcccacctcagcctcctgagtagctaggatgacaggtgcacgccaccatgcccaacttattttttgtatttttggtagagatggatttcgccatgttgctcaggctggtctggaactcctgggctcaagcaatccacctgcctcagccttccaaagttctgggatgacagaggtggccactgcgcccagctggggtgcacatttttatggatcctccagtgataacaattgggcttttagtacatttaaaaaagmaaatatattaaaatgctaccatggatttaattatactttaaattgcatgcctatcatattcaccacttccacatcatgtacttctggaaaagggaactattgtacacataatgcattctccaggctctagatcttgcctgctgcacagttggatgcgtggagcttttgtggcaactccaagccttcccagaggactgtggtctggaaactgctccggtatactccttggggagcagtggcctttgcagaggcctctggctgagagtgctggttgaccccaatattagggttcccccacct

SEQ ID NO: 205781 - DNA, 601 bp, Human
ttgtacacataatgcattctccaggctctagatcttgcctgctgcacagttggatgcgtggagcttttgtggcaactccaagccttcccagaggactgtggtctggaaactgctccggtatactccttggggagcagtggcctttgcagaggcctctggctgagagtgctggttgaccccaatattagggttcccccacctgtgtagtttaagaattttagctggtgtgcagccacccataaagacaaaatccctgagacaccttagagctaagtatggccacatgtctaaattctgactrtgggggccttagtagaagtgacagcgtgcagcttctgggtttgtggccttagaggaaggggcattctcttccacttcctcccttcccacaagttagtgtggggctgaagtggtggaccatcacgaagcccagggatggagcctgacccttgtgctgctagagctgtgagactaaggagccagagtcaccatcccaggctggatctttaggcaagaactcttgtttaaagtactgctattgtggttcattgaagccttcttattctcattttctacagcagctgaacctatgtcttgacta

SEQ ID NO: 205782 - DNA, 601 bp, Human
ctgaaagggatttcattcttttaagaatttcagaaacagagaaaaatgaaacaaaagaatttaactgatatttttattaattgttctttcagtcacactttcccttctatcacattatcatacgtgttcatagtatctttgctgtttgcaaaagtgttatttgcacttttaaatccttctgtcatataatactataaagcttctatttaacatttttcctttgcctttctagtgttacaagggtttggtgtctgcactctgagtgacagactcttactgaaggtctttcctgagctgtgcrcaatgctaagtgctcatgtgtacgtgatcccatttgctccttaaagcaacctatgaaccttagacccattttgtagaggaacagaaaggcccagtgaggtgaagtgatttggcacaagccacttactacattgcttgacggaggtggaattcggacttcagggctaaaatcgaagcctgatgttctttctgttgggtagcacatggccccacagtgctacacaattctatcagaaagcagaaaacatgacccactggaaacagcagcacattatccgatgattttaaactctttgtgatg

SEQ ID NO: 205783 - DNA, 601 bp, Human
ctgttgggtagcacatggccccacagtgctacacaattctatcagaaagcagaaaacatgacccactggaaacagcagcacattatccgatgattttaaactctttgtgatgtccattacaattttataatcctattaaggatttgcaagatgaagaagtccaaataatcaggcttttgaaaacttttagccaggaagagtttcacatatcttagatagtaatggttaggtcatttagaatttgaataaattgctgaaatggtatgaaatcactaaaaagaaatgaagtcagaagaattaytagacttcacataaaagagtactgaattaggtcacagaaaaatcagagctggtaacactggcaggaactaggatttctaggttccaggaatggcaggctgagttattcagaccaaattgcccactgaaagcagctccaaatgttgaataaaatacaactatatatataaagcatcacatcaaagggctgacagaactatgaggaattaaccaggttaaaatggaaggcaacacaggaacccagacaggtaagcagaggattagatatatctttattctgagcaaacttgttaatcccaga

SEQ ID NO: 205784 - DNA, 601 bp, Human
ttagagagagatgcagtccatcttatgatccttgcatagtcttgataccaaaacttaactatgtaagaaaagaaaattgtaggacaatcttacttatgactatatttgcagaaatcctacgcaaactattagcaaactgaatttaatagtatataagaaaataatacatcatgaccaattttagtttcctccaacgaacacaagcttagtttagcactttagtattagcccatgtaattaaccaccttagcaggtattttaaaaacatgtatgattattgaaatagatgcttaaaaagtaytgaatacaattcagtattcataaatgatttaaaaacacatataaaagatgactttcttattctgataaggagtacatgcaaaagcctatagcaagcattgtatttaataatgatgcattgagaaactacagagaatgccattgcaatttctaatcagcattggagtgggggtcctagctcatgcagtaagtcaaggaaagaatacgtgtatgctgattgaaaaatccactagatacctatttatctttccccagccggacaccattcctcttctcccttgaagtggtcatgtgactgagt

SEQ ID NO: 205785 - DNA, 601 bp, Human
tagtttagcactttagtattagcccatgtaattaaccaccttagcaggtattttaaaaacatgtatgattattgaaatagatgcttaaaaagtattgaatacaattcagtattcataaatgatttaaaaacacatataaaagatgactttcttattctgataaggagtacatgcaaaagcctatagcaagcattgtatttaataatgatgcattgagaaactacagagaatgccattgcaatttctaatcagcattggagtgggggtcctagctcatgcagtaagtcaaggaaagaatacrtgtatgctgattgaaaaatccactagatacctatttatctttccccagccggacaccattcctcttctcccttgaagtggtcatgtgactgagttctggccagtggaatgaggaagaagtgacatatgctgcttccagacctggctcagaaaaacctgctgcatgatctgtgaacttctctctctgtattcagtctgcctgctgaatgctaatgccgagggaaacctttgaagcaacatattgaaggtggtgaagcttctgtcagcctaggcccctgaagagttcatgaagtagaactgt

SEQ ID NO: 205786 - DNA, 601 bp, Human
caagcattgtatttaataatgatgcattgagaaactacagagaatgccattgcaatttctaatcagcattggagtgggggtcctagctcatgcagtaagtcaaggaaagaatacgtgtatgctgattgaaaaatccactagatacctatttatctttccccagccggacaccattcctcttctcccttgaagtggtcatgtgactgagttctggccagtggaatgaggaagaagtgacatatgctgcttccagacctggctcagaaaaacctgctgcatgatctgtgaacttctctctctrtattcagtctgcctgctgaatgctaatgccgagggaaacctttgaagcaacatattgaaggtggtgaagcttctgtcagcctaggcccctgaagagttcatgaagtagaactgttaccatctcctttttattaactgctttgcatgattatgaaagaaacttctattatgtccacccactggaatttcagggtttacttatttaccaggaactggtaccttgaagtggagtgctaccaaaaaatctaaaaaaaaaaaaacaaaaaacaaacaaacaaaaaaaaacatggcattggcttag

SEQ ID NO: 205787 - DNA, 601 bp, Human
aaactacagagaatgccattgcaatttctaatcagcattggagtgggggtcctagctcatgcagtaagtcaaggaaagaatacgtgtatgctgattgaaaaatccactagatacctatttatctttccccagccggacaccattcctcttctcccttgaagtggtcatgtgactgagttctggccagtggaatgaggaagaagtgacatatgctgcttccagacctggctcagaaaaacctgctgcatgatctgtgaacttctctctctgtattcagtctgcctgctgaatgctaatgccragggaaacctttgaagcaacatattgaaggtggtgaagcttctgtcagcctaggcccctgaagagttcatgaagtagaactgttaccatctcctttttattaactgctttgcatgattatgaaagaaacttctattatgtccacccactggaatttcagggtttacttatttaccaggaactggtaccttgaagtggagtgctaccaaaaaatctaaaaaaaaaaaaacaaaaaacaaacaaacaaaaaaaaacatggcattggcttagtagttaggcagctggaagatctaatattggg

SEQ ID NO: 205788 - DNA, 601 bp, Human
aaaacatggcattggcttagtagttaggcagctggaagatctaatattgggtcttgtttatggttggtaaacacaccaattctctccaaattgttttatgaattcagtgcaaatccaaatgagatcccaacagttttgttgttgttgtcgtcagtgttgttgtttttgtggatcttaaaagctaatctcgacatttatagggaaatgcaaaagtccaagaaaagcaaagatacttgcataagaacaagaggatgagaggacttattcttccagatatcgagtcattataaagctacagctrttaagacatggtgtatctgatgtagggacaaatgaatagagagttcagaaacagacccactcatgtcaaagtatgacaaatgacacagttggcatttcatagtactggggaaataatggcttcttaatcaatagtgataagataattttcttataggaagaaagttaattggatttctgcctcacaccatacacaaaaatcaattccaagtagattgaatacataaatgtcaaaggcaaacgtacgaaatttcaagtagataattttcatgaccttgggtttcggaagcatttcctaaac

SEQ ID NO: 205789 - DNA, 601 bp, Human
attggcttagtagttaggcagctggaagatctaatattgggtcttgtttatggttggtaaacacaccaattctctccaaattgttttatgaattcagtgcaaatccaaatgagatcccaacagttttgttgttgttgtcgtcagtgttgttgtttttgtggatcttaaaagctaatctcgacatttatagggaaatgcaaaagtccaagaaaagcaaagatacttgcataagaacaagaggatgagaggacttattcttccagatatcgagtcattataaagctacagctgttaagacatkgtgtatctgatgtagggacaaatgaatagagagttcagaaacagacccactcatgtcaaagtatgacaaatgacacagttggcatttcatagtactggggaaataatggcttcttaatcaatagtgataagataattttcttataggaagaaagttaattggatttctgcctcacaccatacacaaaaatcaattccaagtagattgaatacataaatgtcaaaggcaaacgtacgaaatttcaagtagataattttcatgaccttgggtttcggaagcatttcctaaacaagacacaaa

SEQ ID NO: 205790 - DNA, 601 bp, Human
tttttagaaaagacagactgctgagagaaaaaatgggcaaaggacttgaattgtggcaaagaaacataaaatgataattaacgttattaatcaggaaaatgcaaattaagatcaagtgagattccattacacaccaagcagactgacaaaaagtgaaaatctgacattagcagactttaatgaattggcaagcatttagagctccaggaattcttgtgcagtcatgtggttttgtaaattggtacgactactctggaaaaatagttcagcatgtagttaagttgaagacatgcaaacactmtacagcaacaattctatttctaggtatgtactcaagagaaactcatgcatatgtataagagaatacatgtcaagaatgttctttacagccccaggctggtaatgttcattaagggtagaatgtataaatccattgtggtgcattcatacaatgggatattatgaagccatgaaaatgaagaaaatggaaggacctcatgatcataattgtaagtgaaagattcaaactgtagtataattgcatttatattaattttaaaaataggctgtattagtctattcccatgctgctaataaagac

SEQ ID NO: 205791 - DNA, 601 bp, Human
tctgagcagaggagaagtcatcatcttatgcttcattatagatgaagcgtttctgttttcctctgcttcctctggctctgccgagagggagagaaacctcagagcagtcttagggttgtttgtccctttaaaatcttctttggagaaagtggatggagaaatctcaagcagttggtagatgtcaggaggtcagttctcatcaagaatgccccaaagcccagtcctcattaatcagtttatagagtactatggaagcattttaagcacaaggtgttgtttctgagccagtaattctctttcyactcaacactgaaagtccactgcttgctttcctggtacatcaagacagccaaatagtgtcaataatttttcctcatagtttttcaaaagccaagtggagggcacagtgaactttgcaacacttgttgcatctgtgggaaagggggctctgggtcattgcttggtgattatgctcactcagggttccagaaaatactgtagctcatgggagtctgatctttccacgcatctctggtccccaccgtgacttgtcaagatacctatgtggttacacgcccaacccaccagcttcaggacccac

SEQ ID NO: 205792 - DNA, 601 bp, Human
tggaagtccaagatcaaggtgtcggcagggctggttccttctgagtgctgtgagggaagggaaggatctgttccaggcctctctccttggcttctagatggctgtcttctccatgtttatattcacatcagcctagttttatgtgcgtgtgtttctttgtccaagcttcttgtttttaaacagtctctagtcatattggcttagtgctaaccctcatgacctcgtttaacttaattacctctgtaaagacccgttctccaaggaaggtcacattccgaggttttaggactccaacatatcwtttggagggagacacgattcaacccgtaacactttctcataacagtaaattgaattatgataaaagtagttctcggaaatatatacatgatatcacaaaataattattttcagagttgtgtacccttttttaaaatcctccaatagagatttagttgttttaaaaacaagttgacttgctttagtttttagaactttgtgatagtacttgtattttatttatcattatattttctgatgtggatttgcatttgacagtagagctagaagctactataaagctaatctatgttagaattat

SEQ ID NO: 205793 - DNA, 601 bp, Human
catttggagggagacacgattcaacccgtaacactttctcataacagtaaattgaattatgataaaagtagttctcggaaatatatacatgatatcacaaaataattattttcagagttgtgtacccttttttaaaatcctccaatagagatttagttgttttaaaaacaagttgacttgctttagtttttagaactttgtgatagtacttgtattttatttatcattatattttctgatgtggatttgcatttgacagtagagctagaagctactataaagctaatctatgttagaattwtgtaaaaagtcaggtatgcaacagcccccaggaatgagtgcagagacgaggaggctgtaactagagtgtccactggtgagcaagtagaaggacgggtgactcaaggtcagttcgactatgatgagcggagaggcctgagggaggcgctgacagagcccattccttccttggcccctcccacctccctcccagggtgatgtctgcttggctggtcatggtaggcagcctgtgggatggcccccagtgctctctgcccatatgtaattcatctccttgaatatgggctgcatttagcaactc

SEQ ID NO: 205794 - DNA, 601 bp, Human
gatgagcggagaggcctgagggaggcgctgacagagcccattccttccttggcccctcccacctccctcccagggtgatgtctgcttggctggtcatggtaggcagcctgtgggatggcccccagtgctctctgcccatatgtaattcatctccttgaatatgggctgcatttagcaactcacttctaatgaatgacagcagtgatgggagcactctgagactaggtcattaaaagattgtggctcgtattgtgaaaactctctgttaccgcgtgagagatggtaggggaagccagttgcmacgtcatgaagcagccctgtgcagaggcttacatgacaaggacaaaagcctgccaagaactatgtgagtgagcttcgaatcccctcaaccccagtcaagccttcagatgagactgcagccctgcctgacagtttgattacagcgtcatgaaggacttcaagccagaggcacacagccaagctgtgccacagaagctgtgagataataaatgtatatactttgaagctgctaagttttagagtaatttaagtatacttgtatttccattctaaaaaccttttacctatatattctttctct

SEQ ID NO: 205795 - DNA, 601 bp, Human
ttacagcgtcatgaaggacttcaagccagaggcacacagccaagctgtgccacagaagctgtgagataataaatgtatatactttgaagctgctaagttttagagtaatttaagtatacttgtatttccattctaaaaaccttttacctatatattctttctcttatccctttttcgtaatggcttttgtaacagtggtgggctaacctgggcatttatggtggtggttacacatgcagtctctagcatgaaattttctcaattcacatgtcatctgtgcagtttattatcaagtacctgmcacttagaaagccataagttctatttgactcaagcagacctatgaggatgagggagaccccattatccccattttccagatgctcaaagacagagagcaatgaccttagaataaatgaaattaaagagaagtaagactggatgcagggagatgagttgggcagctattataggattccgggccagaagtaatggaagctttgtctaggatggtggaagtatgggtgggagggagggatatttaggaagtacaaagaccagaacttggaacttcactggaagtggagagtcaataagaggg

SEQ ID NO: 205796 - DNA, 601 bp, Human
acttcaagccagaggcacacagccaagctgtgccacagaagctgtgagataataaatgtatatactttgaagctgctaagttttagagtaatttaagtatacttgtatttccattctaaaaaccttttacctatatattctttctcttatccctttttcgtaatggcttttgtaacagtggtgggctaacctgggcatttatggtggtggttacacatgcagtctctagcatgaaattttctcaattcacatgtcatctgtgcagtttattatcaagtacctgccacttagaaagccatawgttctatttgactcaagcagacctatgaggatgagggagaccccattatccccattttccagatgctcaaagacagagagcaatgaccttagaataaatgaaattaaagagaagtaagactggatgcagggagatgagttgggcagctattataggattccgggccagaagtaatggaagctttgtctaggatggtggaagtatgggtgggagggagggatatttaggaagtacaaagaccagaacttggaacttcactggaagtggagagtcaataagagggacaggtccaggtccagg

SEQ ID NO: 205797 - DNA, 601 bp, Human
ggagggatatttaggaagtacaaagaccagaacttggaacttcactggaagtggagagtcaataagagggacaggtccaggtccaggtcatggctggtgattttttgtacaagtgtacagagaagcagaggcagatttgtggggaaggtaagttaagttgtgaaagtgcagagtctaaggtgcccatgacatgggcatccaaggggctgtttggaggagccatgggctgtttctgccttgcagggaggattgttaggactgctaactgggctaatgcttgtgaaacacagggcctagcacrtggtaaatacctcataaacaggaacccttattattattgggagttgtcaacttatatttgctaaatgaaaccccagttgctgataagattacttgggaaaagtaatgagataaaagcagaagaggcagggcacagtgactcacgcctctaatcccagcactttgggaggctgaagtgggcggatcatgaggtcaggagttcgagaccagcctgactaacatggtgaaactcggtctctactaaaaatacaaaaattagccaggcgtggttacacgcacctgtaatccgagctactgagga

SEQ ID NO: 205798 - DNA, 601 bp, Human
ggaagtggagagtcaataagagggacaggtccaggtccaggtcatggctggtgattttttgtacaagtgtacagagaagcagaggcagatttgtggggaaggtaagttaagttgtgaaagtgcagagtctaaggtgcccatgacatgggcatccaaggggctgtttggaggagccatgggctgtttctgccttgcagggaggattgttaggactgctaactgggctaatgcttgtgaaacacagggcctagcacatggtaaatacctcataaacaggaacccttattattattgggagttrtcaacttatatttgctaaatgaaaccccagttgctgataagattacttgggaaaagtaatgagataaaagcagaagaggcagggcacagtgactcacgcctctaatcccagcactttgggaggctgaagtgggcggatcatgaggtcaggagttcgagaccagcctgactaacatggtgaaactcggtctctactaaaaatacaaaaattagccaggcgtggttacacgcacctgtaatccgagctactgaggaggctgaggcaggagaaatgcttgaacccaggaagcaaaggttgcac

SEQ ID NO: 205799 - DNA, 601 bp, Human
gtggggaaggtaagttaagttgtgaaagtgcagagtctaaggtgcccatgacatgggcatccaaggggctgtttggaggagccatgggctgtttctgccttgcagggaggattgttaggactgctaactgggctaatgcttgtgaaacacagggcctagcacatggtaaatacctcataaacaggaacccttattattattgggagttgtcaacttatatttgctaaatgaaaccccagttgctgataagattacttgggaaaagtaatgagataaaagcagaagaggcagggcacagtgrctcacgcctctaatcccagcactttgggaggctgaagtgggcggatcatgaggtcaggagttcgagaccagcctgactaacatggtgaaactcggtctctactaaaaatacaaaaattagccaggcgtggttacacgcacctgtaatccgagctactgaggaggctgaggcaggagaaatgcttgaacccaggaagcaaaggttgcactgagctgagattgcattactaaactccagcctgggcaacagagtgagactccatctcaaaaaaaaaaaaaaaaaaaaatgcagaagagaggg

SEQ ID NO: 205800 - DNA, 601 bp, Human
ccaaggggctgtttggaggagccatgggctgtttctgccttgcagggaggattgttaggactgctaactgggctaatgcttgtgaaacacagggcctagcacatggtaaatacctcataaacaggaacccttattattattgggagttgtcaacttatatttgctaaatgaaaccccagttgctgataagattacttgggaaaagtaatgagataaaagcagaagaggcagggcacagtgactcacgcctctaatcccagcactttgggaggctgaagtgggcggatcatgaggtcaggasttcgagaccagcctgactaacatggtgaaactcggtctctactaaaaatacaaaaattagccaggcgtggttacacgcacctgtaatccgagctactgaggaggctgaggcaggagaaatgcttgaacccaggaagcaaaggttgcactgagctgagattgcattactaaactccagcctgggcaacagagtgagactccatctcaaaaaaaaaaaaaaaaaaaaatgcagaagagagggcttagtacccgaggaactgattcctccacttgagcggtgggaggggaactgtccaaccag

SEQ ID NO: 205801 - DNA, 601 bp, Human
aaagtaatgagataaaagcagaagaggcagggcacagtgactcacgcctctaatcccagcactttgggaggctgaagtgggcggatcatgaggtcaggagttcgagaccagcctgactaacatggtgaaactcggtctctactaaaaatacaaaaattagccaggcgtggttacacgcacctgtaatccgagctactgaggaggctgaggcaggagaaatgcttgaacccaggaagcaaaggttgcactgagctgagattgcattactaaactccagcctgggcaacagagtgagactccrtctcaaaaaaaaaaaaaaaaaaaaatgcagaagagagggcttagtacccgaggaactgattcctccacttgagcggtgggaggggaactgtccaaccaggcaggacactacactgggcaccacaggaaccaaccccaaccaagaacttaaaaagtggttcaattgtttcatcccactgtatttaattataaaggcagtatttataactactactaaaagtcacatatgataatgccatctataaactcccttatgtaatgattcgtagttctctagggtaccaagagtaataccaagcga

SEQ ID NO: 205802 - DNA, 601 bp, Human
tgactaacatggtgaaactcggtctctactaaaaatacaaaaattagccaggcgtggttacacgcacctgtaatccgagctactgaggaggctgaggcaggagaaatgcttgaacccaggaagcaaaggttgcactgagctgagattgcattactaaactccagcctgggcaacagagtgagactccatctcaaaaaaaaaaaaaaaaaaaaatgcagaagagagggcttagtacccgaggaactgattcctccacttgagcggtgggaggggaactgtccaaccaggcaggacactacamtgggcaccacaggaaccaaccccaaccaagaacttaaaaagtggttcaattgtttcatcccactgtatttaattataaaggcagtatttataactactactaaaagtcacatatgataatgccatctataaactcccttatgtaatgattcgtagttctctagggtaccaagagtaataccaagcgactctggaagcatattaactgccctccagaatactgaaatatgatgatatcctggtgtttgcaatgaagattttcagttcaaggccagtgccttccgtgtgatggtgaagaggc

SEQ ID NO: 205803 - DNA, 601 bp, Human
gtgtgtgtgtgtgtgtgtctgtgtctgtctgtctgcatgtctgcatgtctatgtgtctgtttggcttttaaaagtagggtctattttttaaataaagattgggactcctgtgcctttagtatcccgatagccattgctgctcacattactgcatataaactgcttaatcaccaactcaggggacaaatgctgtcatatctcttttatggttttgcataaataaaactgaccctagattccactgggagatgagttgaaagttcagtgttttcgtaccagctaattgactgaaacccagagkttcagactagaccagtgcttcctttcagcaccactcgcctttccgccatgatgctgtggtctcttttgcactgtccagtggagggcctctggccacatgtggctgttgagcacttgaaatagtggctcactggctcagttcctcagtggctagtgtgactgaggaactgaatcttttaattaatttacatttatatttaagtggccacatgtggctggtggctaccatttagagagcatagcagttcattaaggggtgagcttgtgcgtgtgtttgcatgcccatgtgcattgtagaggg

SEQ ID NO: 205804 - DNA, 601 bp, Human
ctcctgtgcctttagtatcccgatagccattgctgctcacattactgcatataaactgcttaatcaccaactcaggggacaaatgctgtcatatctcttttatggttttgcataaataaaactgaccctagattccactgggagatgagttgaaagttcagtgttttcgtaccagctaattgactgaaacccagagtttcagactagaccagtgcttcctttcagcaccactcgcctttccgccatgatgctgtggtctcttttgcactgtccagtggagggcctctggccacatgtggckgttgagcacttgaaatagtggctcactggctcagttcctcagtggctagtgtgactgaggaactgaatcttttaattaatttacatttatatttaagtggccacatgtggctggtggctaccatttagagagcatagcagttcattaaggggtgagcttgtgcgtgtgtttgcatgcccatgtgcattgtagaggggtggagcatgtcagtctggatccctggccctctgctctcactatggcttatcccaagagcgggacggccatggaacatgggacggccatggaacgtgggttcct

SEQ ID NO: 205805 - DNA, 601 bp, Human
accagctaattgactgaaacccagagtttcagactagaccagtgcttcctttcagcaccactcgcctttccgccatgatgctgtggtctcttttgcactgtccagtggagggcctctggccacatgtggctgttgagcacttgaaatagtggctcactggctcagttcctcagtggctagtgtgactgaggaactgaatcttttaattaatttacatttatatttaagtggccacatgtggctggtggctaccatttagagagcatagcagttcattaaggggtgagcttgtgcgtgtgtktgcatgcccatgtgcattgtagaggggtggagcatgtcagtctggatccctggccctctgctctcactatggcttatcccaagagcgggacggccatggaacatgggacggccatggaacgtgggttcctgcccatcagagtgctgcaccgggagctgctctcaccttttcctgcctggagaccacagcatgagggtcaagttttttccttttcaggaaccaaagtgtctctttgtgtaccccatcctggtgagcaatagagctaagtggacatccatgcctaggtgaccactgtgattt

SEQ ID NO: 205806 - DNA, 601 bp, Human
gcatgcccatgtgcattgtagaggggtggagcatgtcagtctggatccctggccctctgctctcactatggcttatcccaagagcgggacggccatggaacatgggacggccatggaacgtgggttcctgcccatcagagtgctgcaccgggagctgctctcaccttttcctgcctggagaccacagcatgagggtcaagttttttccttttcaggaaccaaagtgtctctttgtgtaccccatcctggtgagcaatagagctaagtggacatccatgcctaggtgaccactgtgattttyatcttagcttagcttagcctgggtcccacagaaagcagagcccaagccagaggcttgtgtgtgaggattcactgagatgtgtggttccagggagcaggaataaggggcagagagactggggaggaaaagaaggaagaccccatacaagttagcccctgccactggtaactggttgtttgagatttatgaaatgactaggcattcgggagaagatgaggaagcatgtttccattgaatgccatcagtcataggttgattctgcacttctgagctgcacgtgtgtgagctcagggtactgtg

SEQ ID NO: 205807 - DNA, 601 bp, Human
actgggtactgtggctggcctagcaagaggcagatggggccacagggatctaaagtgatgcattagtgtcctctgggtccactgtctccaaagggtccttctcactccgatccagggaaggcagctgactgcaatggctcaggaatgatttgccacgatggagtgactttctggcacctctgatagaggtgagaaagaaaaacacagttcaattttagcagagtgcatcctgctgcagtcatatggtgatataatatgtacttttatataggttatataccataattatgtataatacgtrtatctatataatatatagctatataataataatagtaatactgttagaacagcaacaacagtaccaacagagtacttactaaatgctaatcaagcagttttaagtcatgtatagatcttaggtgtttatctgtatacatatatttgtttagctgtagatgtgtatctctctatgtctttatataaagttaaatgcattcatgtatttatgaggcccttttaagttttgaaacttgaatgaatttctgactgtttattcagttgatataactgataatacaaacattgcaaaatcagcaat

SEQ ID NO: 205808 - DNA, 601 bp, Human
tgttagaacagcaacaacagtaccaacagagtacttactaaatgctaatcaagcagttttaagtcatgtatagatcttaggtgtttatctgtatacatatatttgtttagctgtagatgtgtatctctctatgtctttatataaagttaaatgcattcatgtatttatgaggcccttttaagttttgaaacttgaatgaatttctgactgtttattcagttgatataactgataatacaaacattgcaaaatcagcaatttgcaatgcctgtgagaggtgatgttatcagctttgataccrtaaagaggttgatcagtgctttagcctttaccttaaaaagttatgtggtttctaatacattcacaaaatggggaaaattgccgatctaaccaactgctttattcactgagggaaggagagcagggagctgaagaggtgacccccggactgggctttcctgtgttttatatctagggtaagcttgaacaagctcctgaaaccacagaggtgtttaaggtagggagggtcatttcttaacactcctcgattatggtctagaactctgtactgtagtcagaaacatttagtttgatttctaaa

SEQ ID NO: 205809 - DNA, 601 bp, Human
gtaccaacagagtacttactaaatgctaatcaagcagttttaagtcatgtatagatcttaggtgtttatctgtatacatatatttgtttagctgtagatgtgtatctctctatgtctttatataaagttaaatgcattcatgtatttatgaggcccttttaagttttgaaacttgaatgaatttctgactgtttattcagttgatataactgataatacaaacattgcaaaatcagcaatttgcaatgcctgtgagaggtgatgttatcagctttgataccgtaaagaggttgatcagtgstttagcctttaccttaaaaagttatgtggtttctaatacattcacaaaatggggaaaattgccgatctaaccaactgctttattcactgagggaaggagagcagggagctgaagaggtgacccccggactgggctttcctgtgttttatatctagggtaagcttgaacaagctcctgaaaccacagaggtgtttaaggtagggagggtcatttcttaacactcctcgattatggtctagaactctgtactgtagtcagaaacatttagtttgatttctaaaagtggggaaattctgccca

SEQ ID NO: 205810 - DNA, 601 bp, Human
tcatgtatttatgaggcccttttaagttttgaaacttgaatgaatttctgactgtttattcagttgatataactgataatacaaacattgcaaaatcagcaatttgcaatgcctgtgagaggtgatgttatcagctttgataccgtaaagaggttgatcagtgctttagcctttaccttaaaaagttatgtggtttctaatacattcacaaaatggggaaaattgccgatctaaccaactgctttattcactgagggaaggagagcagggagctgaagaggtgacccccggactgggcttycctgtgttttatatctagggtaagcttgaacaagctcctgaaaccacagaggtgtttaaggtagggagggtcatttcttaacactcctcgattatggtctagaactctgtactgtagtcagaaacatttagtttgatttctaaaagtggggaaattctgcccatgactcattctgttcattttacatacactgctttcctcttcagaaggcttggtgtttctggccccatcactacattcgggacatttgtcttctttgagcgctgctgggacccctatacactaactgtaatgttgact

SEQ ID NO: 205811 - DNA, 601 bp, Human
gcaaaatcagcaatttgcaatgcctgtgagaggtgatgttatcagctttgataccgtaaagaggttgatcagtgctttagcctttaccttaaaaagttatgtggtttctaatacattcacaaaatggggaaaattgccgatctaaccaactgctttattcactgagggaaggagagcagggagctgaagaggtgacccccggactgggctttcctgtgttttatatctagggtaagcttgaacaagctcctgaaaccacagaggtgtttaaggtagggagggtcatttcttaacactcctsgattatggtctagaactctgtactgtagtcagaaacatttagtttgatttctaaaagtggggaaattctgcccatgactcattctgttcattttacatacactgctttcctcttcagaaggcttggtgtttctggccccatcactacattcgggacatttgtcttctttgagcgctgctgggacccctatacactaactgtaatgttgacttaggttactaatttaatagtcttcttcactagcctgctcccagtgaccccctagtacccagcttcttcagcagcttctttatatgtgaa

SEQ ID NO: 205812 - DNA, 601 bp, Human
tttctaatacattcacaaaatggggaaaattgccgatctaaccaactgctttattcactgagggaaggagagcagggagctgaagaggtgacccccggactgggctttcctgtgttttatatctagggtaagcttgaacaagctcctgaaaccacagaggtgtttaaggtagggagggtcatttcttaacactcctcgattatggtctagaactctgtactgtagtcagaaacatttagtttgatttctaaaagtggggaaattctgcccatgactcattctgttcattttacatacactkctttcctcttcagaaggcttggtgtttctggccccatcactacattcgggacatttgtcttctttgagcgctgctgggacccctatacactaactgtaatgttgacttaggttactaatttaatagtcttcttcactagcctgctcccagtgaccccctagtacccagcttcttcagcagcttctttatatgtgaagtttggagtgacagtattgcttaccacagagcagccatttgaacataaaattagctgattttatcacagggaccaattgttgagctaattagatgtgcagtact

SEQ ID NO: 205813 - DNA, 601 bp, Human
taagcttgaacaagctcctgaaaccacagaggtgtttaaggtagggagggtcatttcttaacactcctcgattatggtctagaactctgtactgtagtcagaaacatttagtttgatttctaaaagtggggaaattctgcccatgactcattctgttcattttacatacactgctttcctcttcagaaggcttggtgtttctggccccatcactacattcgggacatttgtcttctttgagcgctgctgggacccctatacactaactgtaatgttgacttaggttactaatttaatagtsttcttcactagcctgctcccagtgaccccctagtacccagcttcttcagcagcttctttatatgtgaagtttggagtgacagtattgcttaccacagagcagccatttgaacataaaattagctgattttatcacagggaccaattgttgagctaattagatgtgcagtactgctgaggagccagaaaccaaaagtgattttccattgaaactgtggttttctgcaaagttggctgggttgtggataccagcctcaccagcgactgtcagagttttggctgaagaagtttgctcatttct

SEQ ID NO: 205814 - DNA, 601 bp, Human
attttatcacagggaccaattgttgagctaattagatgtgcagtactgctgaggagccagaaaccaaaagtgattttccattgaaactgtggttttctgcaaagttggctgggttgtggataccagcctcaccagcgactgtcagagttttggctgaagaagtttgctcatttctaatcagattaaaagaggcaggaaagacttaaggaggaggatggagtcttaaggagtgaaacttgaacttcacgctgggtttgctgaccttgaacatgctggattctgcttacagaatttgacagckgcttcatatctttggtgagcaaccctaaccctaatacaactttgcataaaatggaggggggtgtttttgccttcaaggagaagacttgataatcttttcttagcctcattaaaaaaaaaattttcctcaaatctttggtggaattatttgcttatagcactaattgcaagacatcatctaatgtattattgtttttggattgtcaaatatggacaatttatctcccaagtgagcccatcatgagaaacatttcccagtatcctaaactgaatgtggcctccggtagagtgagggtggttc

SEQ ID NO: 205815 - DNA, 601 bp, Human
tcccaagtgagcccatcatgagaaacatttcccagtatcctaaactgaatgtggcctccggtagagtgagggtggttcacgtgtaattcttccatcctgagaatgtgactccagctcatttaggaattaaatcttttcccactgagaaattatgtttcttgaaatgtgaaagacagcaaatctaaagagcattctcctggccatatgacctggctccttctgccagctcttcaagtcttcaagaaagcacaatgctttctctgggtatttctctcgcgaaaaagagagaagaaaagcagcrttttcctttgtatatattttacaatatattaagttctaataaggataaaatgtttctggagtcattgttaaattacccactgtgtttcaaatataaaacagtgttttaaaggctgtatctatccgtctctcagtgtttgtccacccttccatccatccacccacctgtccctatcatcagtatatagctacaatctttaaatatttgccataattttatcttaaacttcaactatctagcaatttattatctctcatctctgcgtttgtttataattaatacagggtcattttaaagaaa

SEQ ID NO: 205816 - DNA, 601 bp, Human
aatgtgactccagctcatttaggaattaaatcttttcccactgagaaattatgtttcttgaaatgtgaaagacagcaaatctaaagagcattctcctggccatatgacctggctccttctgccagctcttcaagtcttcaagaaagcacaatgctttctctgggtatttctctcgcgaaaaagagagaagaaaagcagcgttttcctttgtatatattttacaatatattaagttctaataaggataaaatgtttctggagtcattgttaaattacccactgtgtttcaaatataaaacaktgttttaaaggctgtatctatccgtctctcagtgtttgtccacccttccatccatccacccacctgtccctatcatcagtatatagctacaatctttaaatatttgccataattttatcttaaacttcaactatctagcaatttattatctctcatctctgcgtttgtttataattaatacagggtcattttaaagaaaagttcccaaagtgaaaggtaaaaaaacagtatgcatgtacaaatgggttccagctagcattttcaaaaataaaggttcagttttgattatttaattttctt

SEQ ID NO: 205817 - DNA, 601 bp, Human
aggattaaccatcttgttcttgaccctaaaccctatcctgcaaactctcttgacaccgaagttgctattatgatcgtacaacattatttggtaggattaagtcagtgggtgatagatgaaactgccttcctctcactactttgccaaatctctgacttttttgtccctgtgttaatatcctatagctactataacaaattaccacaaactggatggcttaaaagcaacagggatttattctctcatggttccagagggcagaagcccaaagtcaatttccctggacccaaatcagggtacyagctgggctctgctcccccaggggctccagggaagaatccctccccggatcttccagcgtctggtgggtgccaccatgcatggcctgtggctgcatcactcaagtctctgcctctgtggccacctgcctcatcctcttctgggcatctgatctcgtcctgcatctctctaataaggacactgacagttgcatttagggcccacccaaacaatcaagaatactcccgcatctcaaccccccttatttagttacatctgtgaaatctgtgccatataaaataacattcacaggttttagggg

SEQ ID NO: 205818 - DNA, 601 bp, Human
cctctgtggccacctgcctcatcctcttctgggcatctgatctcgtcctgcatctctctaataaggacactgacagttgcatttagggcccacccaaacaatcaagaatactcccgcatctcaaccccccttatttagttacatctgtgaaatctgtgccatataaaataacattcacaggttttaggggattggaacatggacattttggggagaccatttttcagatgaccacaggccccataatctggtctccaacctgccagtgtcatgtgtccaccccaaaatgggagactgaaaytgggggctcttcctcgggctgcttaggagaggtgggcgttgttcactaggtgggagcgcatctggcttgccctgaaccccagaacacactcaggtttcccagcgagatgggatttgatttcctctctcgggggtctttatctagttttgaagagaggtgaaaatttgcaaaagtttatcccctttcatacatctctaccttcaaaacagacccaattttactgctatactacttctgaaataaagtggcataccaaaaataacagtagaaaaaaataaatcctaagagctagaaggatat

SEQ ID NO: 205819 - DNA, 601 bp, Human
aagtgatacagcatataaagaagcccgttttgttgccccttgttatggaccgaatatctgtgtccccccaaattcatatgttgaagcctctacccccagtgtgatggtgtttggacatggggcctttgggaggtgatcagggttagatgaggtcctgagctggagctcccgtgatgggactgctgtccttatacgaagagacaccagggagcaggctcttgagcactctattgctgtgtttcttgctgcacacagaagtcatgtgaacacaaatagaactgcctgcaagccctgagaagargacttggaataaacctaccttgccagaaccttgatcttggacttctcagcccccagaactgtaagaaatagaagcctgttattgaagccacgtagtctgttactttgttatggcagcccgagctgacaagagagccctgttttgtgtgctgcactccatggagcgggggcagagcactggcttggaggagaacaactggctggagccctggctctgcctgtagtgaccgtgaccttggagaggtctctatggcccattcttcttttgtaaaatggggaaattaagaacagtggaatgttg

SEQ ID NO: 205820 - DNA, 601 bp, Human
tgttttcaccaacactgaaacatcatttatttgcattggaaaaccctaaatagacatgggtaaatgtcagttgatatgttatggtttggggattacatagctcttcgtctttaaaaaattttttttatctgtgcttttgtttaaagcatgaagttatgatttaaaatgcccatggaaaaaccctgaataattcattgacttaccttagtcaaaaagaaaaatcccccctccccaccgtatgcctagcaatagggataaaattcttcttagtccctttctgtagctttgaggttaaaattaygggtgttattatgaactctaaataagaacctgtgaaataaatattttaaaagtgcccatttctgggaggcaggcacccatatttctgtgtatgcagccacgtagacagctagatcttaggcataatggtttagttgcatgtgggtgattattttcatttccacttattactgtgtgctagactccctgtgtatgagtacagattgccctttcttgcactgtatttagaaatctctgtattacccttgggcatttgttcattaatagggggtggggaaaggaaaagcttgtaataatgggc

SEQ ID NO: 205821 - DNA, 601 bp, Human
tggcaggatatgagtccctgggtggagcccctgtgcagatgccggtatcagtcttttattcacttgcactgagttccatccaagtacatcagaaacagcctaagattctacctactgcccaggttgatggtggaagacagcattcttgtgaggatcaaggagacattttgattttagtagaagtacagtagaagtatagacacaaaataatcctggccaacatagggtgatgtttgaatgaatgaattcacatttctccacgggccacactcctactcatctttcagtggcaacaggggartgtttagtggctcccatatgtgatgtccagaccccttgtggaatgcaagatgattttacggtgtatccagatgaatcttttaaatctcagttatgtgtttataatatatattaagaaaactgcagtgaatgtttgaagcccacaatttcctgaaggtgatggctgaggtgaagagcaggaaatggaacctacacacacagctgcattccttgcagagatgcctcttccgcaagtctttgggcggagaaaaaccacagggaggtccccgatgacttgggcagcagtggctctgtacttgct

SEQ ID NO: 205822 - DNA, 601 bp, Human
atggtggaagacagcattcttgtgaggatcaaggagacattttgattttagtagaagtacagtagaagtatagacacaaaataatcctggccaacatagggtgatgtttgaatgaatgaattcacatttctccacgggccacactcctactcatctttcagtggcaacaggggaatgtttagtggctcccatatgtgatgtccagaccccttgtggaatgcaagatgattttacggtgtatccagatgaatcttttaaatctcagttatgtgtttataatatatattaagaaaactgcagwgaatgtttgaagcccacaatttcctgaaggtgatggctgaggtgaagagcaggaaatggaacctacacacacagctgcattccttgcagagatgcctcttccgcaagtctttgggcggagaaaaaccacagggaggtccccgatgacttgggcagcagtggctctgtacttgctttgtgtatgaccttgggttgttgacctgtctaagcctaggttttcttatttgctaaacaggataatagtggctacttcttaggcagttataaggatgatatggtgtatatgtaaagtgtctgtcac

SEQ ID NO: 205823 - DNA, 601 bp, Human
gagctttcatgtttgccacgaaagccagagagccgggagcacctcaggagcggagatgaaaggccatttgtgtttgtgcatgtgtatttagcgcttaaagggcaggaaaaagaaagaaaatagatggtcccgctttgcacttacttcaaaatgtgccttactccctctggtgggaccatttaactccagcgcgccacccctcccccgctctcgccgctcccgtctgccccgctgcctcggcccacgtgatggctgttcgggccccgccgagccatcttcccgttgctatggcagccggcgyggcgagcccgcccattggctgcaagcgaggaggaataaaaggctctcgtgtcctaggtctagtgccctgcgccatggccccgtgcaggtagaggcctgggcatggtgcgttgcaggacgggccgggcgcagggaccgccccccgcaccgtgcgccccacccagctgtccagaaacggtcagggtcaatgtcatcagcttctccatggaatgggaagcaggtgaaggacaaaagcaaggctcataagggaaagtgagccaccttttccttcacccttaacacctcccagctctgttttttt

SEQ ID NO: 205824 - DNA, 601 bp, Human
tacttcaaaatgtgccttactccctctggtgggaccatttaactccagcgcgccacccctcccccgctctcgccgctcccgtctgccccgctgcctcggcccacgtgatggctgttcgggccccgccgagccatcttcccgttgctatggcagccggcgcggcgagcccgcccattggctgcaagcgaggaggaataaaaggctctcgtgtcctaggtctagtgccctgcgccatggccccgtgcaggtagaggcctgggcatggtgcgttgcaggacgggccgggcgcagggaccgcccmccgcaccgtgcgccccacccagctgtccagaaacggtcagggtcaatgtcatcagcttctccatggaatgggaagcaggtgaaggacaaaagcaaggctcataagggaaagtgagccaccttttccttcacccttaacacctcccagctctgttttttttttttttttttttttttgtagtgtttgaatttgaaatccggccctgtgaccctttctactcacagacactgcacgtgaggcctgagcctaagtttagctgtcagattccatttaccttggccatgccccgtggctccaaag

SEQ ID NO: 205825 - DNA, 601 bp, Human
ggatgcacactcccgctccctgattccaagctctgtgcatgctctttccattctgtcactgggccaggtagattccctctggacatgtcacaccctcacagatttataaatagggaatgggctctaggaggaagatcgctcctccctttcttctcattccgtatcttgccaatatcacattaaaagaatatgtcactagtgtttaatttgtcaagatcaggggctaatggttgaggattttttgtggttccttctgctggcagaaacacatttgcaaacacaaaatcttttaataaaatakcaagatttagtaagaaagaaaaatactgtgagaaaaaaataggacctgattggaggaacattattatgccagagacacttggttgacttaaacactaatatattatttttatacatattcacacaaagggtgctgtgtggtttcaggaatccacagagcctaacacccaagcacatgtgatagaaaaaaaaaattttaatccttttttttttttcattttcatttctgtttggcttctttacaaagtcgtcattgaaaattgctgtatggttatttttccctcttgtgttacagaccaaa

SEQ ID NO: 205826 - DNA, 601 bp, Human
caagctctgtgcatgctctttccattctgtcactgggccaggtagattccctctggacatgtcacaccctcacagatttataaatagggaatgggctctaggaggaagatcgctcctccctttcttctcattccgtatcttgccaatatcacattaaaagaatatgtcactagtgtttaatttgtcaagatcaggggctaatggttgaggattttttgtggttccttctgctggcagaaacacatttgcaaacacaaaatcttttaataaaatagcaagatttagtaagaaagaaaaatastgtgagaaaaaaataggacctgattggaggaacattattatgccagagacacttggttgacttaaacactaatatattatttttatacatattcacacaaagggtgctgtgtggtttcaggaatccacagagcctaacacccaagcacatgtgatagaaaaaaaaaattttaatccttttttttttttcattttcatttctgtttggcttctttacaaagtcgtcattgaaaattgctgtatggttatttttccctcttgtgttacagaccaaactcagtgtctgatgtacagtggaata

SEQ ID NO: 205827 - DNA, 601 bp, Human
cccctcctgagatatgtgtacagtcaaatgggatcactgctgtcgctaggccagcagctctagaagcctatgttacttttttttttttttctgagacggagtctcactctgtcacccaggctggagtgcagtggtgcgatctcggctcactgcaagctccacctcgtgggttcacgccattctcctgcctcagcctcccgagtagctgggactacaggcgcccgccaccacgcctggctaattttttttatttttagtagagacggcatttcactgtgttagccaggatgatctggatctcctgacctcgtgatccaccagcctcggcctcccaaagtgctgggattacaggcgtgagccaccacgcccggccaagcctatgtcgcttttaagatgaatccaaaaagactgtgtgctactaggctacagaaagcagcattaagtctgatatacatcaatccatgttcaagcagattcctctctgtctctggaagttggttaatttttctggtcctgatattggatattgtcacattttccttgatagtgtcatccggtgaatgatttttcatcttgaaccttatactcctcctctctcggc

SEQ ID NO: 205828 - DNA, 601 bp, Human
ccctcctgagatatgtgtacagtcaaatgggatcactgctgtcgctaggccagcagctctagaagcctatgttacttttttttttttttctgagacggagtctcactctgtcacccaggctggagtgcagtggtgcgatctcggctcactgcaagctccacctcgtgggttcacgccattctcctgcctcagcctcccgagtagctgggactacaggcgcccgccaccacgcctggctaattttttttatttttagtagagacggcatttcactgtgttagccaggatgatctggatctcstgacctcgtgatccaccagcctcggcctcccaaagtgctgggattacaggcgtgagccaccacgcccggccaagcctatgtcgcttttaagatgaatccaaaaagactgtgtgctactaggctacagaaagcagcattaagtctgatatacatcaatccatgttcaagcagattcctctctgtctctggaagttggttaatttttctggtcctgatattggatattgtcacattttccttgatagtgtcatccggtgaatgatttttcatcttgaaccttatactcctcctctctcggca

SEQ ID NO: 205829 - DNA, 601 bp, Human
ccactgtgtcccgccagattggaagttattatacccactttataaagtggcgaggatggcatgttttgattcaattcaaaaggtatttaccaagtacctccgtattcaagggaggggatgtggaagcaacctatatacaaacttaaaacctgcaaaggcatcagcaaagagcatctcacatcagcttctctgttcacttggtccctacttgtcttcacagaaagaacagttcttgtgtggtaatcaaaatggtatttctttgagaaaaaagatgcccctgataagaaagacaacaaatackttgatgtggaaacagcctccaacatgaagtaagatttccaactgatcagatccttaatttagatgtcaagtgagaggttgactatttgtagggctctgtggattccagactcccactcagacctactgaattagggtccttaggggtggggccaggaaatatgaaatgtttaaaactcctgtattaggcagttctcgcgttgccataaatacctgagactgagtaatttataaagaaaagagatttaattggctcatgattctgcaggctttacaggaagcctgctggcatctgctcggc

SEQ ID NO: 205830 - DNA, 601 bp, Human
ccaatgagcttttgtttgatatttaccagattaaaaattaaaactgagaaattaaaaaaacccgaacacacattcattccatcagccatcgagtgttgatgtcatcacactccgtgtagcttccagaaaacttcacctgcacccatgagagaataagagtgaacagggaaatatatcttagcatgatgataagaataattttgaccttgtggatcctggaaaagattctggagttccccgggggcctctgagccgcacggaactgctgatcttgattgcacaggttacccaaccctgttcrtctgcctcacagagaagcacagaagtcaaatctgaggccgttgtatcactgagcagcacagctggggcagggtcttagggaaggcctccgagtccagcgcagttccctggccttacagacgaggaacctgagccccaaagaggtaaagcaatgctcccaagctcacacagcgtgggtgccaagctcagttaataacccagagcttctgcccagtgggcttgcccctgcatcccagttgagtgacttagggaccaggctccggtgaaagacagcttggttccaatcccagctctgccactg

SEQ ID NO: 205831 - DNA, 601 bp, Human
taatattttagcagtcactacttctagaaatcatgaccagcttttctccatctcttggtctcaattgttccttttcccagcaaccttcaggcttgctcagcagcatcgcaggggaaagggattccagaatccatggtgagaacaccgtctctatctgccttcacaacagactgaaggcagagctaagatcggatgtaattagtttacatgtcagacccaacaatccatgctgtacgtcatgcaggagtgatcagtgttttcagggtggaatgcaatctcataatgaagcggtgaatagtaktattgcagttgaataacctgcagcatgatgtatggtgattagaatttgtttctggcatatggttttctttttcttgtttttcccccaaagtggaatgtctgcttctgtagcaccgtccatttgcaaactgcgttccccaaccactctttaattgtctcctacatcagttcatgggagagcttagtgagggtaggtaacccagtgctccttattcaacaaatgtaaatgtagcgctttacatttgtaaagggtgctggggggtccctggtgacctgcacacacaagtcaatagatttctgc

SEQ ID NO: 205832 - DNA, 601 bp, Human
ggatgtaattagtttacatgtcagacccaacaatccatgctgtacgtcatgcaggagtgatcagtgttttcagggtggaatgcaatctcataatgaagcggtgaatagtattattgcagttgaataacctgcagcatgatgtatggtgattagaatttgtttctggcatatggttttctttttcttgtttttcccccaaagtggaatgtctgcttctgtagcaccgtccatttgcaaactgcgttccccaaccactctttaattgtctcctacatcagttcatgggagagcttagtgaggktaggtaacccagtgctccttattcaacaaatgtaaatgtagcgctttacatttgtaaagggtgctggggggtccctggtgacctgcacacacaagtcaatagatttctgctgaaaaaattttaatattaaaacatcatacataaatttgaagacttcatatgcaaacagcaacaaaaccaaaaaataacaaaggacagagattttaaaataatctcttataaataactagttttatctacccaaccaaataaaataatcagcactccgtatgctacctcagatcctgttcagacatatgt

SEQ ID NO: 205833 - DNA, 601 bp, Human
ccccaaccactctttaattgtctcctacatcagttcatgggagagcttagtgagggtaggtaacccagtgctccttattcaacaaatgtaaatgtagcgctttacatttgtaaagggtgctggggggtccctggtgacctgcacacacaagtcaatagatttctgctgaaaaaattttaatattaaaacatcatacataaatttgaagacttcatatgcaaacagcaacaaaaccaaaaaataacaaaggacagagattttaaaataatctcttataaataactagttttatctacccaamcaaataaaataatcagcactccgtatgctacctcagatcctgttcagacatatgtgggtatcaataatgaatgaatcaattgattcatcctcagtcttgctgagtgtctttctgggagataccacttgtggctcttgtttacccaaagatcactttgaagatagaacattctatagtcccagatagcatcttcttgcctggaactgacataagatccatatctctaagccacaggactggagcttctccctcttgctaaggaagttgcatgtatcacccaaaagatactggctttgaggt

SEQ ID NO: 205834 - DNA, 601 bp, Human
accactctttaattgtctcctacatcagttcatgggagagcttagtgagggtaggtaacccagtgctccttattcaacaaatgtaaatgtagcgctttacatttgtaaagggtgctggggggtccctggtgacctgcacacacaagtcaatagatttctgctgaaaaaattttaatattaaaacatcatacataaatttgaagacttcatatgcaaacagcaacaaaaccaaaaaataacaaaggacagagattttaaaataatctcttataaataactagttttatctacccaaccaaakaaaataatcagcactccgtatgctacctcagatcctgttcagacatatgtgggtatcaataatgaatgaatcaattgattcatcctcagtcttgctgagtgtctttctgggagataccacttgtggctcttgtttacccaaagatcactttgaagatagaacattctatagtcccagatagcatcttcttgcctggaactgacataagatccatatctctaagccacaggactggagcttctccctcttgctaaggaagttgcatgtatcacccaaaagatactggctttgaggtgagaa

SEQ ID NO: 205835 - DNA, 601 bp, Human
aagtgccttgactctctggtcttccttcaccccatctgtacggtgatctctcagcagctgttcacctctaatggtggactatagagtggtggctgaatccctccaccatcaggcaatcaaagccagccatttccaccgaggcaggtggatcacaaggtcaggagttgaagaccagcctggccaagatggtgaaaccccgtctctactaaaaatacaaaaattagacaggcgtggtggtgggctcctgaagtcccagctactggggaggctgaggcaggagaatcgcttgaacctgggaggyggagattgcatcaatccgagattgcgccactgacactccagcctgggtgacagagggagactccgtctcaaaaaaaaaaaaaaaaaaaaaaaaaaagccagccatttccaatggccttgacataaggattatgttgcattaagtaaggatcattaaggatctgaatgagctaactaccatgagtttgaatgaatctagagcttgatctcaggtttgcatgtcagggatagcttcgttcaccaacacattctccattactgtgtgaggtggtgtacaagacctcaggttcactcttgggcc

SEQ ID NO: 205836 - DNA, 601 bp, Human
gtcttccttcaccccatctgtacggtgatctctcagcagctgttcacctctaatggtggactatagagtggtggctgaatccctccaccatcaggcaatcaaagccagccatttccaccgaggcaggtggatcacaaggtcaggagttgaagaccagcctggccaagatggtgaaaccccgtctctactaaaaatacaaaaattagacaggcgtggtggtgggctcctgaagtcccagctactggggaggctgaggcaggagaatcgcttgaacctgggaggcggagattgcatcaatccragattgcgccactgacactccagcctgggtgacagagggagactccgtctcaaaaaaaaaaaaaaaaaaaaaaaaaaagccagccatttccaatggccttgacataaggattatgttgcattaagtaaggatcattaaggatctgaatgagctaactaccatgagtttgaatgaatctagagcttgatctcaggtttgcatgtcagggatagcttcgttcaccaacacattctccattactgtgtgaggtggtgtacaagacctcaggttcactcttgggcctgggaatgactacagtgg

SEQ ID NO: 205837 - DNA, 601 bp, Human
aatcaaatatgattggaagaatcttcaaagtggtagaggactataccaatgggatatattattacaaataataattatgaagaattctaatgtattttccaaaaacttatgagatgctaaacatctctgttacatattgcacatttaaaaataattacattatgagaagtgcgttattcgggtttctgtttcttttctggtgttttaagctcactctaaaaaggcctggcaaatcaagatgtgtttgcatgaaactaaaggcactaggaggagactaaaaggtcaaatctaccttttaggwgcagcctgcattccaaatggaggcatttcagcttactcaagtctttatttagtctaaccacttggcaacctactttatttagtttaatctcctggcaacctactctaaccacttggaaacctacagcctacctacagaatcatagttcagccatccattcctaccttcctagtgtttttgtttatttgcttggctcattgtattgtgtttatgtgtacatgtttgtgagggcagctcaactgtgacctcttgtgcagtgttccaaatttacaaagttccctaaggataccaggccatccc

SEQ ID NO: 205838 - DNA, 601 bp, Human
catattgcacatttaaaaataattacattatgagaagtgcgttattcgggtttctgtttcttttctggtgttttaagctcactctaaaaaggcctggcaaatcaagatgtgtttgcatgaaactaaaggcactaggaggagactaaaaggtcaaatctaccttttaggagcagcctgcattccaaatggaggcatttcagcttactcaagtctttatttagtctaaccacttggcaacctactttatttagtttaatctcctggcaacctactctaaccacttggaaacctacagcctacmtacagaatcatagttcagccatccattcctaccttcctagtgtttttgtttatttgcttggctcattgtattgtgtttatgtgtacatgtttgtgagggcagctcaactgtgacctcttgtgcagtgttccaaatttacaaagttccctaaggataccaggccatccctggccctcttttctcttatatatgggcaaaggctgagtgacttggggtcctgacctcagtaaatgcagtcttatcctcacccattgctttgcttattcactgaacctagtcctgaaaatatgggagtataga

SEQ ID NO: 205839 - DNA, 601 bp, Human
tcactctaaaaaggcctggcaaatcaagatgtgtttgcatgaaactaaaggcactaggaggagactaaaaggtcaaatctaccttttaggagcagcctgcattccaaatggaggcatttcagcttactcaagtctttatttagtctaaccacttggcaacctactttatttagtttaatctcctggcaacctactctaaccacttggaaacctacagcctacctacagaatcatagttcagccatccattcctaccttcctagtgtttttgtttatttgcttggctcattgtattgtgtttatgtgtacatgtttgtgagggcagctcaactgtgacctcttgtgcagtgttccaaatttacaaagttccctaaggataccaggccatccctggccctcttttctcttatatatgggcaaaggctgagtgacttggggtcctgacctcagtaaatgcagtcttatcctcacccattgctttgcttattcactgaacctagtcctgaaaatatgggagtatagattcagaatcagctctcacctctgtgtggatgactttgcgctcagcatgcatttcatagccctgctcatggcttataag

SEQ ID NO: 205840 - DNA, 601 bp, Human
gaaaggcaagcggaagagagaaagctccagagtggaaaagagggaaagcttcaagtatgtcctgattggaggctgttggcctggggaagttgcagacaggctaacaagatgcggggaatcttgtgtaatagattaggggtacctatttagctttcttgggttagtcctagaatttcaagccaggacaaaagttagggaaactgtcagggaaattaatcaagtccttgccatttggggctgattgctaaaggggttgttgtttggcttcctgaactggtgactctaaacagtaggttggctycctgggctggttgctgcaggttgtgggtgaaggttctgtttttatatagtcagactagtgtccatttgtatcttcagcctctcaccattcccccaactgaaggtgctgctgttacttgttccctgtcctcacagaccctctttccacaccccatcattctggctgaagccccctccaatgtgttttcacagcacctgcactttgatcacaacacatgtcccctttattttagtcattactggttcgttttcccttttggtccaaacactccttgagggcaggggttctgtcttgttcatc

SEQ ID NO: 205841 - DNA, 601 bp, Human
aggcacatggtaaatatctgttgagtaaatgaatgatgcagctggtcattgcatctagaataaccctcacgttaaggtgggttcatccttagatggatttgggattgatgaattcaaacgtgcagttaagagtttgcttgtaaatcctgagaccatatagacagagtagcagcataattgtgtgtctgaaccatcagtgtttactcagcccttccttttgtagttctagtaaattgctttgtatttgaatccgtgctagggccttctccgcggagatttttttttcttgaggcctacaccrgcagcatggccaaatgcctatttcccaacttatatccagaaattattgcctttttttttttttttttttttttttggacagagtcttgctcttgctctgtcgcccaggctggagagtgcagtggcgtgatctcggctcactgcaacctctgcctcctgtgttcaagcagttctcctgcctcagccttccaagtagccgggactacaagcgtgcgccaccgtgcccggctaatttttgtatttttagtagagacggggtttcaccgtgttggccaggatggtcttgatctcttgacctcgt

SEQ ID NO: 205842 - DNA, 601 bp, Human
tagttctagtaaattgctttgtatttgaatccgtgctagggccttctccgcggagatttttttttcttgaggcctacaccggcagcatggccaaatgcctatttcccaacttatatccagaaattattgcctttttttttttttttttttttttttggacagagtcttgctcttgctctgtcgcccaggctggagagtgcagtggcgtgatctcggctcactgcaacctctgcctcctgtgttcaagcagttctcctgcctcagccttccaagtagccgggactacaagcgtgcgccaccrtgcccggctaatttttgtatttttagtagagacggggtttcaccgtgttggccaggatggtcttgatctcttgacctcgtgatccgcctgcctcggcctcccaaagtgctgggattacaggtgtgagccaccatgcctggccctggcttttctttagtagaagttcagttcatactaccaaggcatctaaaatatttatctccttactcattaaaactcggcagttacccgtcttactggaaagagggatacgtttgcctaattggggatccaatttttttgggtgagcagcagatctct

SEQ ID NO: 205843 - DNA, 601 bp, Human
cgtcccctctgtgcctagtacggggcctggcgctcctcgattggaaagcaagaaatatttatttaatgaaatgtcactaacacaagctgaggctcttttaggtctaagaaaacggccatctccccgttgctgttttggcccctctagtcctgtgtccttgatgtctgtgaacggccactcctgagttctgtctgtgaggctcactgctgctagcatgttggagcccaagggcattgaggggccttcccctgtcacccccttttgttacagacacacattccagagaggtgaaccctcgctraaggttacagtttgccttccagctaccgctgaagcttgtggcttggttaaacaggcctccctgagtagaaatgatggactcttctgagttgagagacctcggattgtacttgaaactttccattctccagctgggccatttggggcacttcctgttcttgtgtgaaatcattagccacaatctggagacctacgagtggaatttggtctgcagtcttcgtttctttctttaaagtttgaattctgatgcttctcacaaagacacctgctttgcagatagctctggtccccaccgtccatc

SEQ ID NO: 205844 - DNA, 601 bp, Human
aagatggattttagagttaagtgagtccaggacgaccatcgatgtctcaccgaattggaactcactggtcagcagccgtaatgtttgaattggaaccagaaaatagctctcaaatttgcagagtcagctttgccgggcttcaggctgagtgggctcatagctggttggccctgtatctctggcctgggcaccgtggctccttgccaaggccggcaacccttgatggtggcagcacggagcagaccgagcccccagccgacttacccccgaggcctcgcgcctcccccttcacagcattgcrccttccctcttccagttcccagggtcgcttcaggctgtcccagccctctgcctagtcagctgtcagggaggggaagtggcaagtccaaggccgccagagggcttcctactgcctgccctgcctgtggcatttcttaaggtgacaaagagtgtgtttttaaaccaccctccagaactcttactccccatgaattctctgcagctgctcccccagaattgactggaaagagaacctcgtttaagctgcctatgcagcagaatgctgtgagtcagacgacgtcctgccaagtgcaacctgaga

SEQ ID NO: 205845 - DNA, 601 bp, Human
tactgcctgccctgcctgtggcatttcttaaggtgacaaagagtgtgtttttaaaccaccctccagaactcttactccccatgaattctctgcagctgctcccccagaattgactggaaagagaacctcgtttaagctgcctatgcagcagaatgctgtgagtcagacgacgtcctgccaagtgcaacctgagatgcttcagtggaagcttgttcctcggtggtgacaccttgtctccacgctcatccattcgagtgaaaattcatctctttccctcccaaaaacatcatgtaatgaatgwtggttgtttttgctctgaaggagacttttttttttttttttttttttttttttagacggagtctcgctctgttgccgggctggaatgcagtggcgtgatcttggctcactgcaacctctgcctcttgggttcaagcgattctcctgctccagcctcccaggcatctgggaccacaggcatgcgccaccacgcctagctaatttttgtatttttggtagagatggggtttcaccatgttgaccaggatggtctcggtctcttgacctcatgatccacccgcttcagcctcccaaagtgctg

SEQ ID NO: 205846 - DNA, 601 bp, Human
gagacagtgcttcttgcagtcttgccaataaaaagccactcagcagcagctagctttctgtttcgcgcactcaccaaaatatatatacatgaaagaaattgctacgctgatctggtactgaagaccaccagggccgtccgtggcgtgtacggaggagggacctgggagggtctgggagtctccttggaggttcctcccacttcggcatccgtgagtcctgtatttggtaccggaggcccggaggcccgtgtatctgtgttagcagttggtcccctgcagagcacgacacctgacgtttctrtaacgagatgcaattttctgggtagcctctgtaccgtctttctagctatgccttttcctttaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgt

SEQ ID NO: 205847 - DNA, 601 bp, Human
cactcagcagcagctagctttctgtttcgcgcactcaccaaaatatatatacatgaaagaaattgctacgctgatctggtactgaagaccaccagggccgtccgtggcgtgtacggaggagggacctgggagggtctgggagtctccttggaggttcctcccacttcggcatccgtgagtcctgtatttggtaccggaggcccggaggcccgtgtatctgtgttagcagttggtcccctgcagagcacgacacctgacgtttctgtaacgagatgcaattttctgggtagcctctgtaccktctttctagctatgccttttcctttaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaa

SEQ ID NO: 205848 - DNA, 601 bp, Human
ggtactgaagaccaccagggccgtccgtggcgtgtacggaggagggacctgggagggtctgggagtctccttggaggttcctcccacttcggcatccgtgagtcctgtatttggtaccggaggcccggaggcccgtgtatctgtgttagcagttggtcccctgcagagcacgacacctgacgtttctgtaacgagatgcaattttctgggtagcctctgtaccgtctttctagctatgccttttcctttaggtacccaagcatgttcactggaagaagagaacacagactgggctgcagayggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaaagatgaaggaaagggctttaaggatacaaaggaccttattatggaaggaaagcagtgttgtcaagagagctaaaatg

SEQ ID NO: 205849 - DNA, 601 bp, Human; identical to SEQ ID NO: 22192

SEQ ID NO: 205850 - DNA, 601 bp, Human; identical to SEQ ID NO: 22193

SEQ ID NO: 205851 - DNA, 601 bp, Human
gtgttggtgtagttctctgatcagcagcaccggcatggatgtgggagctcggaggaaatacactctcaggccccaccccagacctgaatctgcatcgtagcaaaatccccaggtgacctgtatgcacgttaaaggtttgagaagcacagggtagagcacttgagattgtgtaggttccaaatccacctgtcaacagatggaaggaggggatgcatcctcctgggtttcctcagtgcttctgaggtcacatggagactgggaatcacaggcaggagtggtcagttcatctgctgagagggartagctttttttatttttattttttgagaaagagtcttgcactctgtcgcccaggctggagtgcagtggcgtgatcttggctcactgcaacctccacctcccaggttcaagcgattctcctgcttcagcctcccaagtaactgggactacaggcatccgccaccacatctggctaagttttgtatttttattagagatggggttttaccatgttggccaggctggtcttgaactcctgacctcaagtgatccgcccaccttggcctcccaaagtcctgggattacaggtgtgagccacctc

SEQ ID NO: 205852 - DNA, 601 bp, Human
ctcagtgcttctgaggtcacatggagactgggaatcacaggcaggagtggtcagttcatctgctgagagggagtagctttttttatttttattttttgagaaagagtcttgcactctgtcgcccaggctggagtgcagtggcgtgatcttggctcactgcaacctccacctcccaggttcaagcgattctcctgcttcagcctcccaagtaactgggactacaggcatccgccaccacatctggctaagttttgtatttttattagagatggggttttaccatgttggccaggctggtctygaactcctgacctcaagtgatccgcccaccttggcctcccaaagtcctgggattacaggtgtgagccacctcgcctggccgagagggagtaactttggagctgcacttcactcagcattcacggtactagcgcccgctttttgcttcagactgacattcacatcagtattaaaatcattcacggttatttcctttctcctttgtaggtctttcgatggattttctagtgcccaaaagaatcaagaacaacttttgacattagcaagcattttaagggaagatggaaaagttttcgatgag

SEQ ID NO: 205853 - DNA, 601 bp, Human
gggtgtggtagcagccagctcctgattgctccgagctgtacatactcagtggcagatttcctgggaagaaggctagttgagtcagaagccagcatttcatctggagtttgccgtaacatttttagagtcctaaagagaattccatatttgctgttttctaatctcatacccacaatgcttacttatttaataacaactgtttgactttaaaaaagaataatgaaatatatacagtgtttgtaagatgtatgggtgggagctatgcttctatagtttggtgaagctactgtatatttatttmagatatgtgaaaatgtgaaaaaagaaagtaagccttagaatcaaggaattaatggtaataattctcacttatgtaatactctgtgacacagaccatactagaaatttacatactttgtctcaactctcacaaaaactctagaaggtaagtatgtgtgtagttattttatagatgagaaaactgaggctcagagaggtcaagtgacttatccaagtcctataactagtaaatgaaaaagataggatttgaacctcgataatgagaatgtaaactaatactcttctcaccactctgtccctc

SEQ ID NO: 205854 - DNA, 601 bp, Human
tgaatgtacgaaaaactattttgtgaccatgactcatttttttctctccaaagctttggagttttccaaagttgattgtaatatctctgagttctctgagaagaattagagtatagtaggaataacaactctgtcttttttgacacaaaatattcatctagtttcagagtcagagtccttgtattaatttttttgagggaataaattcattatccttcatccctaatactttgtagtaatattccacatttattgaacttttactatttgccactgtcctaagctcttcgtgtatttgaattttttttttttagtcaccagtaaaagctgtctgagttaggaactatgattatttccattccattttacagatgggcaaattgtgttcagagaagttaagtaacttgttcaacatcccactaatttggaagtggcagagtcagcaatcaatccaagtggcttggctccaaagcttggagttataagcactatgccctaaggcctcccatatgtatcagaatgatgctaagtcaggctacattgacgaggagtcgatcacttaaggagtcagtccacagttggttgtctctttgttactgca

SEQ ID NO: 205855 - DNA, 601 bp, Human
attgacgaggagtcgatcacttaaggagtcagtccacagttggttgtctctttgttactgcatattgtgtcaagctatgtgaaattgccttttatgtgggtttaaagtggtcaaatatgagcaatttcatatgctgatatttgaaatttttaatagttaaatctaaaactttcatgttttgatcagtacaatgccatttcctcttgttttgtcctaaacaaagatagtcactttttggtcagtatcctctggaaaaggaacctctcaaggcttgaagatggggggcaaaattatgactctytttcttctttcccagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggtaaaccattccaccgtttctttcccccatgcccaacaaa

SEQ ID NO: 205856 - DNA, 601 bp, Human
aattgggcctctcatcacctgtaaaagaggtacaggtcccaaggataagctatgaggtgtagtttgggacatctaggggtagcagtgatatggttgaaccacctacatattggacagcagcctgaggagtgctaattcagcactcttgtttattagcaagaaaaatctctgctaaactcactttgcactatttttttttttgcaatttcattactttttttctttgtttgtgggttaggaacaatttttttttcaataggttattgtggtacaggtggtatttggttacatgaataagttstttagcggtgatttgtgagattttggtgcacctatctcctgagcactatacactacaccctgtttgtagtcttttatccctcgtgcccccccagccttttccccaaatccccaaagtccattgtatcattcttattcttttgcaccctcacagtttagcttccacatgtcagtgagaacatacaatgtttagttttccattcctgagttacttcacttagaataatagtctccaatctcattcaggtcgctgcagatgccgttaattcattcctttttattgctgagtagtagtccatcg

SEQ ID NO: 205857 - DNA, 601 bp, Human
tatttatttttttcaaagaaccagctttttgtttcatttatcttgtagtttttttgtttcaatttcatttagtttttctcttgatattggttatttcctttcatctctagggtttgggtttggtttgttcttgtttctctagttccttgaggtgtgaccttagaatgtcagtttgcactctttcaatctttttgatgtaggcgtttagagctatgaacttcccttttagcaccacttttgctgtatcccagaggtttggtttttataggttgtgttattattgtcaatcagattgaagaattttttttttattatactttaagttctagggtacatgtgcacaacgtgcaggtttgttacatatgtatacatgtgccatgttggtgtgctgcacccattaacttgtcatttacattaggtatatctcctaatgctatccctcccacatccccccaccccatgacaggccccagtgtgtgatgttccctttcctgtgtccaagtgttctcattgttcaattcccacctatgagtgagaacatgcagtgtttggttttttgtccttgcaatagtttgctaagaatgatggtttccagcttcat

SEQ ID NO: 205858 - DNA, 601 bp, Human
ttaagccggtctgaaaagcgcaatattcgggtgggagtgacccgattttccaggtgcgtccatcacccctttctttgactcagaaagggaactccctgaccccttgtgcttcccggtgaggcaatgccttgccctgcttcggctcgcgcatggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttkgctcctcctcccccaggtgttctttgtgcttcttgtatttggatgtctaggcctctatcaaggccagggaagttttcccctattgctcctccaaatatgttttcaaaacttttagaattcccttcttccttaggaataccaattattctttaggtttggtcatttaacataatctcagacttcgtaggggctttgttcattttttcttattcttttttctttgtctttgttggattgggttaatttgaagaccttgtcttcagactctgaatttttttcttctacttgttcaattctatt

SEQ ID NO: 205859 - DNA, 601 bp, Human
ccttaggaataccaattattctttaggtttggtcatttaacataatctcagacttcgtaggggctttgttcattttttcttattcttttttctttgtctttgttggattgggttaatttgaagaccttgtcttcagactctgaatttttttcttctacttgttcaattctattgatgagactttccagaggattttgcatttctataagtgtgtccagtgtttcctgaagttttgattgttttttctttatgctatgctatctatttccttgaatatttatcccttcacttcttatttttkttgttgttgttgttgtttttattatttcctttcactgggcttcacctttctctggtgcctccctgattagcttaataactaacctcctgaattcgttttcaggtaaatcagggatttttttttatcttggcttggatccattgctggtgagctagtgtgatttttttggggtgttaaagaaccttgttttgtcatattacctgagttgggtttctggttccttctcatttgagtgggctctgtcagagggaaactctagggctgaaggctgttcttcagattcttttgtctcaaagggtg

SEQ ID NO: 205860 - DNA, 601 bp, Human
gcttactattgctaaggaaaggatcttctcaagggaaactgtcttacttgccctaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatggtgagttgggaaaaggtggccacattgtgacagggaacattgttggagggtatccactgggyctagtatttggtggatgctttcacatacatagtcctttttagtcatcacgagggcaaggagtagtagatggctcttccctgttttacatgtgaggacactgaggctcctaagattatgcagcagataaatggcacagctaaaattccaaccttggtctctctgactgcatagattgtgctcttgccattaggctattctgcctcataatgtggaatagcacacagtctaaagttatatagtatatggtcaattactttgctgtgggttgcccactgatacaattaatcaatattgatttg

SEQ ID NO: 205861 - DNA, 601 bp, Human
tttcactacaggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcaggtattgtcagggttatctggctggaaagcctgctgggagaaggatgaagctgggttgctggataggagttaagcatgraactgggttctaaagtttagggaatagaagaaaaataatcaagctggtccatcagaaattaatagttggtgacctcatactatcttgcatgttattttttgtactgacaaatatatatcttccttagccttgcagataattcatgatatcctttcatcatcttcttctttcctccctccttccctccctccctctctctccctttccctctccccctctccctttccctctccctcacctcggtggcccctaaaccttgctcctgatccataaatctgctttaatatttgcttgtcttct

SEQ ID NO: 205862 - DNA, 601 bp, Human
tgtgtgtgtatggaagaggatgggaggacagactgcaggtaggggtaccagagaggaggctattttagttcaggccagggaggatgagggccagaaccagggcagtagcagtgaagatgaagaggaggaaacaggttgagagctgaagatggaattttcagatccccaacacgtatgggggcgtggaaaatgagatctatatggaaaaggaacaatcagagtggttgtaaaaggaccagaaagtatgttgccacagaaaccaaggaaggagagtttcaagaaatagggaataggagagatgggtgtgtgtgtgtgtgtgtgtgtgtgtgtgtgtttggtagtggagaatagttcaatgttgtcaggatgtggatcatggtggaggtgaggccagaaaggacagttgagcactcatcccaaagacagagatattcacgagtagagttaaagtggcatagagaggaaggcagaggtgttgaggatgactcagcagtttcaagttgtgtgaaaccatagtacatagctgatgccatgctcctggccagtgctggagtagtctggtctcatctccccaccttgtcttgtgtttttgttttccagc

SEQ ID NO: 205863 - DNA, 601 bp, Human
gtgtgtatggaagaggatgggaggacagactgcaggtaggggtaccagagaggaggctattttagttcaggccagggaggatgagggccagaaccagggcagtagcagtgaagatgaagaggaggaaacaggttgagagctgaagatggaattttcagatccccaacacgtatgggggcgtggaaaatgagatctatatggaaaaggaacaatcagagtggttgtaaaaggaccagaaagtatgttgccacagaaaccaaggaaggagagtttcaagaaatagggaataggagagattggtgtgtgtgtgtgtgtgtgtgtgtgtgtgtgtttggtagtggagaatagttcaatgttgtcaggatgtggatcatggtggaggtgaggccagaaaggacagttgagcactcatcccaaagacagagatattcacgagtagagttaaagtggcatagagaggaaggcagaggtgttgaggatgactcagcagtttcaagttgtgtgaaaccatagtacatagctgatgccatgctcctggccagtgctggagtagtctggtctcatctccccaccttgtcttgtgtttttgttttccagccat

SEQ ID NO: 205864 - DNA, 601 bp, Human
ctgagtttgacaaacacttgacataaagctggtctcctcagaaatagaaaggacaatttggaggctattgcagttttctctgtgagagaagcttgtggcttggactcgggaagtggcagtttaaacgaaaaaataattttgaaggaattgctgataggatttactgatgcaatagataacggtggtaagggaaatagaagaagtagatgtggaaagaaatgagtagaccctttctttcaacgtgtttataaactagtagaagggatcattttaaaagagaggggcacttagccctttaacmtgtggtttagatataaagtgcattagaggtggagaagtgaagaatgtagaactctatttgggccaaaatagtcagggagggctttctggaaaagaaacatgaattgagtcttggataatgagtggactctcatagatacttgggggtggggtgggcaggtaagttccagaaagaggataacaaaatgaatgaagatttcaaggtaggaatgaatgagatgtgtgagagaaacagtcagagttccatgtagttggagtgctagttgagtttgagacaatgtgtgggaggtggaactggatt

SEQ ID NO: 205865 - DNA, 601 bp, Human
gtgtctcttgttaaatctttcttttaattaatttcaacttttattttaggtatgggggtacatgtgcaggtttgttacatgggcatgttatgtgatgctgaggtttggggtacagatcccatcacataggtagtaagcatagtacccaatagtttttcaacccttgccctccaccccaatttctattgttgccatctttatgtccatatgtacccaatgcatagctaccacttataagtgagaacttttttgttttctgttcctgcattcatttgctgagaaattaatggcctccaggtayatccatgttgctgaaaaggacataatttcattctttttcaagtctgcatagaattccattgtttgtacataccacattttctttatccagtccaccactgatgggcacctaggttgattctatgtctttgctattgtgaatagtgctgtgatgaacatatgaatgcatgtgtctttttgatagaatgatctatttttcatgctttttttttttttgagatagagtctcagtctgtcacccaggctggagtgcagtggtgtgatcttggctcactgcaaccaccacctcccaggttcaagc

SEQ ID NO: 205866 - DNA, 601 bp, Human
aatggggtgatttgttttttgcttgctgaattgtttcagtttttggaaattttaaaaagtgacttcccgtctctgaacctgggtatactcatcttgaaaatgatgcagtataagatgaaagaacaggactagaaaacgagggagggaaggagcagcagacttgaatctaaatcctggctcactttctggctaacaatgtcacttgtagaataagtcctgtcatctctgtgcaattgattgcacctctggcacctacctaccccataggcctattagaaatatcaaatgataaatctgtttktaaactagacagaatcctataaggagaaaatctgtaagatttcattccctccctatgtctcaccatcctttgccctctggttgcagcagtagttaatactttcctgccaccttgtatcttgccttttgtaaaactaatttcatcaagacatcattagggctggagctaaagcctgtggcttctgattcttagcccagtgctcttatagtatgaattatataccaaatttgtatttggatgatggcaaacaaggaaacctgccatcttttttttttttttttttttttttttttttttttt

SEQ ID NO: 205867 - DNA, 601 bp, Human
atccctcggccaaggactggaccagaagaacacttgggaatcttgggtaagggaattctacttccctcctagtgtttagcagcctgaactccacctagggaagctatgttataccaggatggcctcactattccccattctcaatgttttcatatgatatactggaattatggaatattttatgaaacaaccatgacaataaacagtgaagggggaggaaggaaatcatgaattcatgaaccagattttactgggttttctatagcttcaaggtatgagtctctgaggatggtaagttgtrataaatgctaggggcagaataacttaggaacatcaaaatgtgaaaaaactatatatatacacaaggaatcagttttttcattgtaccgctgtttaattattgctttaggtggtttcccccttattctagttatggtacagaagggacccactgactcctaaagagatcctctcaattctttattgtctgccaaacttatcactctttatcgtcaatgattccacagcaccttgattctttagacccttgggctgttatagatagagggtaggggtgggaaaagtggaggtaattggaagt

SEQ ID NO: 205868 - DNA, 601 bp, Human
ttctatgactttatagttttgtaaaaatgttgtcataaaggttgtacatatgcttggttaagctaatccattaatgcttcttagtttttcttactacttttaaattatatttctaatagattatttataatgtagagaaatgctattcatttgtgtaagttgaacctgtatctagtagtcttcttgaactcccttattagttttactagtttgttgattccagaaatattgagagttttattcttctatctcttattcctttccatttccatatatgtttgccaggatcaccaatactagkgatggtagtggtcatcttcaactttctcccaatctcaagagagtgcatgtaaagtttctctctctttgctatgattcctttttggaaatttatttaaatttccaaatgaacaaacatttatttaaaattttaatcaagataactgacctaaaaccttcagtagaagaataattttaaaaccatcttcggggtggaggagaaaatggtggataggaagactaacttgcagctcccactgggatggacagagcagcatgtgaagatccatatcatgaatctttgctccaggaactacagcag

SEQ ID NO: 205869 - DNA, 601 bp, Human
gaaggtctaccacaataccaccacacatctgctcagggatgaacaagggctgactgattagtaagctcttgaaaatgtttaagctcactgcatcctttcaggtctccaaggaatgctaagtttcctccctgtcatgagagacacaaagtgaacttatgttgggagacggaggttggatggcccttgggggctgacccgcagggtgccagactttgggatacagcagagagagcttggcatgacttattactccaggctgtagaatcctggaaaagggttaccatgcagcccacacctggtygactggaggaccaccttagtggaaaggggacaatctgggcctctggcttgccatgtgcacaagcataacaattgcttttttttaacgtgtggatggaatatttgatccattccaaccaggcatttgcatcttggtatgctgtcttaattgccaaagtttgttttaagtctttaacttctatgatcctctagtaaaatgaatgtatgattttgggaaattaaaaaaactggttggggcagtccatccttgctctctagtggtccacagaatgttgggccaactatggcataaaagctctac

SEQ ID NO: 205870 - DNA, 601 bp, Human
gtacaggcacaccatgggtgatcaggccacgcttccactcaaatggagtaggcaagttccaaagactagtcttaccaactttcagatgtctggactccaggtgccatttccttcccggtgttcagccactgcattgatcctccacaggggcctgccatgcgctgctctggcaaggcattccactggggcaattgcctacttgggagcactctcaggatctgtgtcactcaagctggccagagtcccccgcagggatgctccacagggcaggcctaagccgcctaaggggctgcctcgactrtctgttaatcaccttgcttcctggtcaaggaaccaagaaatgtagcaggaaaagccacagataaaacccctcagacactgagttaaagaaggaagggttttattcggccgggagcttcggcaagactcatgtctccaacaactgagctccctgagtgagcaattcctgtcccttttaagggctcacaactttaagggggtctgtgtgagagggttgtgatctattgagaaagcagggggtatgtgactgggggctgcattcactggtaattagaatggaacagaacaggacagggatttt

SEQ ID NO: 205871 - DNA, 601 bp, Human
aaagatacttgcacatgcatgtttatagcagcacgatttgcaattgcaaaaatatggaaccagcttaaatgcccatcaatcagagtggaaaaataaaatgtgagatagatatagatatagacatagacatagatatagacatagacatagatatagatatatagatatagatgtagatatatatgtgccatggaatactactcagacagaaaaagtaatgaaatagtagcatttgcagcaacctggatggaattggaaactgttattctaagtgaagtaactcaggaatggaaaaccaaayatcgtatattctcactcataagtgagagctgagctatgaggatgcaaatgcataagaatgatacaatgaactttggggattcaggggaaagggtgggagggaggtgagggataaaagactacacattgaatacagtgtacactgctcaggtgatgggtgcacaaaagtatcagaaatcaccactaaagaactcattcatgtaaccaaataccacctgttccccaaaaacctattgaaataaaaataaaacattttgaagactacctctataaagtaccttttccaagatgtttataccag

SEQ ID NO: 205872 - DNA, 601 bp, Human
gcatccatcaaatttatgtactgaaccaaagtcttgattttcagaattcactggtcagtcatgattctagaccaaggctgtcaaaacatgtttttatttttatgtatttatttatttagtttatttaatttttaattttttattttaagttcaggggtacatgttcaagtttgttatataggtaaacttgtgtcatggacatttgttgtacagactattatctcactgaggtactaagcctagtacccaatagttattttttctgatcctttccctcttcccacccctcacatttgagtargctccagtgtctgttgttccctgatatgtgtccatgtgttcttatcatttagctcccacttataagtgagaacatgcagtatttggttttctgttcctgcattagtttgctaaggataatggcctccagctccatctatgtttctgccaaggacatgatctcattcttttttatggctgcgtaatctacagtgtacttataatgcttctttttttaaaaaaaaaaatccaatctactattgatgggcatttcagatgactctgtgtctttcctattgcgaatagtgctgcaatgaacata

SEQ ID NO: 205873 - DNA, 601 bp, Human
tattatctcactgaggtactaagcctagtacccaatagttattttttctgatcctttccctcttcccacccctcacatttgagtaagctccagtgtctgttgttccctgatatgtgtccatgtgttcttatcatttagctcccacttataagtgagaacatgcagtatttggttttctgttcctgcattagtttgctaaggataatggcctccagctccatctatgtttctgccaaggacatgatctcattcttttttatggctgcgtaatctacagtgtacttataatgcttcttttttwaaaaaaaaaaatccaatctactattgatgggcatttcagatgactctgtgtctttcctattgcgaatagtgctgcaatgaacatattcattcatgtctttatgatagaacaattcatattatttgagtatatacccagtaatgggattgctgagttgaatggtagttctgtttttatgtctgtgaggaatcgccatactgttttccaccatggttgaattaatttacactcccaccaacagtgtataagcattcccttttctctgcaatcttgccaccatctggtttttttttttgacat

SEQ ID NO: 205874 - DNA, 601 bp, Human
gtagtcttgctctgttgcccatgctagactgcagttgcataatctcagctcactgcaacctccgcctcctgggttcaagcaattctcatgcctcagccttgcgggtagctgggattgcaggcacatgacaccacacctggctatcttttttgttttgttttgtatttttagtagagacggggtttcaccatgttgggcaggttggtcttgaactcctgacctcaagtgatctgcctacctcagcctcctaaaaagctgggattacaggcgtgaaccaccacacctggccattgagcagttktttttttcctatatgattgttggctgcatgtatgtcttcttttgagaagggtctgttcatgtcctttgcccacttttaaatggggttgtttttaccttgtaaatttgtttaagttccttatagatattgaatattagacccttcttggatgcatagtttgcaaaacttttttcaattctgtaggttttcagttcactcaattgatagtttctttcactgtgtagaaactctttagtttaactagatgccatttgtcaatttttgcttttgttgcaattacttcctgtgtcttcgtcatga

SEQ ID NO: 205875 - DNA, 601 bp, Human
tttagtttaactagatgccatttgtcaatttttgcttttgttgcaattacttcctgtgtcttcgtcatgaaatcattgcctttttgtagatccaggatggtattgcctaagttttcttccagtatttttatacttttggatttcacatttaagtctttaatccatattgagttgatttttgaataaggcgtaaggaaggggtccagtttcagtcttctgcatatggctagtgagttatcctagcaccatttattcaattaggggattgtttgtttccccactgcctgtttcatttttagcttgttgaagatcagatagttgtaggtatgtggccttctttttgggctcattatcctgttatattggtctatgtgtctatttttgtaccagtaccatgctgttttggttactgtagcttgttagtatagtttgaaatcaggtattgtgatgcctccagctttgctctttttgctttggtgaactatttgggctctttttggttccacatgaattttaaaatagtattttctatttatttgaaaaatggcatctgtagtttgataggaatagcattgaatctatacattgctttggactgtat

SEQ ID NO: 205876 - DNA, 601 bp, Human
atcacagtgctgcagatattttgtttatggccagttttggggccagtttatggccagatttttggggcctgttcccaacatccagtatccctggtggttgaagggtctctttctgttggaatttcagaggcccgtggtgacaggaggttgctccttgtcggttcaactcacccattccccttaatttgttggggaccaggaataagtccgagtgcatggtagccccttgtagagtccccagagtcttcccccttcaacccagcttttgtgtcttccttccatctattctcagtatcttccmtttgaatactttttaggagcatgccatttgtgtcagtacctcagtggcatctgttccacctggctgtgtctggtcagccactttacttaacaagtgtttataaatggttaagatttcttgttcataaatggaacagaccatcctctatgtgataattactttcacataatcattttggggtcctagatattttaattgttgttctacttcatcatgtgaagatatgcatgattctcagccagagaaaaatgtgaaaccaagcaggatctagaccctgacctcatagagcatggcctggcc

SEQ ID NO: 205877 - DNA, 601 bp, Human
tactttctcctgaatgttgatcttcattcctatccatactctgaattttatttctgacattttacccatttcagcctgattaagaaccatggctggataactagtgtggtcatttggaggtaagaggacactctagctttttgagttttcagagtttgtgtgctgattctttttcatctgtgtaggctgatgttccttcagtctttgaagttgctgtccttcagataagtttttcttgcttttatattctttgattcccttggggatttgattgtggtgcaaggtgggttcagtagaatgtttttttttttttaagtgatcctcttaaaaatattttagtacatagaaagtcatttatacatattattaaagcaaattatgaaacattatgtgtagaaaacttccatttatgtgaaaaataggccaactgaggaccaattgtaaagaccatcaaggctaggaagaaaccgcatcaactaatgagcaaaataaccagctaacatcataaagacaggatcaaattcacacataacagtattcaccttaaatgtaaatgggctaaatgctccaattaaaagacactgactggcaaattggataa

SEQ ID NO: 205878 - DNA, 601 bp, Human
tatctgataagggacttgtatccagaatccataaggaactattgcttgatgtcattgttatttgacaatgctattatcaaaaaacccataacccaatttaaaatgggcaaaggatttgaataaacattgctcccaagaagatgttaaaatggatattaagcacaagagaagattctcaacatggttaaccgtcagagaaatggaaatcaaaactatagtgagataacacttttcacatgctaggataactaaaataaaagatttttaaaagcagacaataactaattttcatgcagatgtwgagaaattggaaccctaatatgttgctggtgagaatgcaaaatggtgcacgtgctttggaaagcagtttggcaattctttaagtggttaaacatagcattaccatacaactcaggaataaatgaaaacatatatccacataaaaacttgtacacaaatgctgatagcagcactattcataataactaaaaagtggaaatgacccaaatgttcatcaactgaagaatgaatgaataaaatatggtgtatctattcaatggactattatttggcaataaacacaactaagtattgatatgtg

SEQ ID NO: 205879 - DNA, 601 bp, Human
tttaaaatgggcaaaggatttgaataaacattgctcccaagaagatgttaaaatggatattaagcacaagagaagattctcaacatggttaaccgtcagagaaatggaaatcaaaactatagtgagataacacttttcacatgctaggataactaaaataaaagatttttaaaagcagacaataactaattttcatgcagatgttgagaaattggaaccctaatatgttgctggtgagaatgcaaaatggtgcacgtgctttggaaagcagtttggcaattctttaagtggttaaacatarcattaccatacaactcaggaataaatgaaaacatatatccacataaaaacttgtacacaaatgctgatagcagcactattcataataactaaaaagtggaaatgacccaaatgttcatcaactgaagaatgaatgaataaaatatggtgtatctattcaatggactattatttggcaataaacacaactaagtattgatatgtgctacaaagggggtggacaatgaaaacatattaaataaaaaaattcagtcacaaaataaaatgtatgatataattcaatatctatggaatgccccta

SEQ ID NO: 205880 - DNA, 601 bp, Human
gccatgtgactgaccatgtccatgctggcatggagaccctcttcactgttttttctcgaacaggtaagtcctaacttccccaaaatgatcatcttctaacactttatctagcctataggaagcaggtaataccaaaaagcctcttgattgtctccttctgatcccacaataagcaggtcttaaggcagagcatagcctccctctaggtattgccccaaccagtatttctaatcctccattgcacctgtccctccattgccccaactgatatttctaatcccctgacacctgtccctctccraattacttcaaaacctgttgagctcacatgaattgacccagcctgaaaccggtttggctctatgcattgaagcctagtgcaggcctgcttcttttgaaataaatttaacttatatacaaatgtattacttgacttcattagagtaactgattatttcaaggaatattgctgattagtctttctaaaaagagaataaaaataattctaatagtcacccattaaattgatttgttctatggggttgtgaaaggcaattctttctttttttctttttttttttcttagagtaaaggtcttgat

SEQ ID NO: 205881 - DNA, 601 bp, Human
ggagtctcacttggtcaggaatggaagaaaagacaggatgaagctactaggttgaggaaaaaaactgaaggttttgaaagctagaggtctcatggcaggggaggataacaggtttttgaaataaagtgtattagagcactgaaaggatgggaggttgttgttagattttagatttctgagatgtaacaattcttgataacaaggttaatgtgaccatgggagtggttggtagaattggagtagacatcaaagttattggagttaaaagggctagaaactgtgaggcttgagtatttgatgrgtcagcacccatggttggaattgagggagaggaagactgagccaggtactaaagacttccataaatgaagagaactgctagctaacaataacaagaaatgattgtagttctagccaaataatatgagcctcaaaagagatatgtttttacaaaaagaggaggaacaatgatctcaaagaagtattgagatgatgtaaatgaagtatggtcctcagagaagaactcagctttattaaatcaaggagaggaagaagtgttctgagaagatgttgaatgtgtagagaagtaggtttcacaagg

SEQ ID NO: 205882 - DNA, 601 bp, Human
caggggaggataacaggtttttgaaataaagtgtattagagcactgaaaggatgggaggttgttgttagattttagatttctgagatgtaacaattcttgataacaaggttaatgtgaccatgggagtggttggtagaattggagtagacatcaaagttattggagttaaaagggctagaaactgtgaggcttgagtatttgatgggtcagcacccatggttggaattgagggagaggaagactgagccaggtactaaagacttccataaatgaagagaactgctagctaacaataacaakaaatgattgtagttctagccaaataatatgagcctcaaaagagatatgtttttacaaaaagaggaggaacaatgatctcaaagaagtattgagatgatgtaaatgaagtatggtcctcagagaagaactcagctttattaaatcaaggagaggaagaagtgttctgagaagatgttgaatgtgtagagaagtaggtttcacaaggagcagggatttcctgaaggaagtgtggcaaatggttggaaatagagcaataatggggatagaggaagtgccaagaaatatttaaataatagcaga

SEQ ID NO: 205883 - DNA, 601 bp, Human
aatcctaactactggggaggctgaggcacgagaattgcttgaaccttggaagcagaggttgtagtaagccgggattgggccactgtactcccgcctgggcgagagtgagactttctctcaaaagaaaactagtcatcataggctcaagtttctggcccacaagtcttatccattctaagttccaccattatcaaaacctatctaaaacttaagaactggccaggtgcagtggctcatgcctgtaatcccagtactttgggaggtcaaggtgggtatatcgcttgaggtcaggagtttgagaacagcctggccaacatggcgaaatcccgtctctactaaaaatacaaaaattagcggggcgtggtggcagatgcctataatcccagctacttgggaggctgaggcaggagagttgcttgaacctgggaggcagaggttgcagtgagccgagatcatgccactgtactccagccagggcaacagagtgagactccatctcaaaaaaaaaccaaaaccaaaaaaaaaaaaaaaaaaaacaaacaggaaaaacataggtattaagaaatgtttacagaattaatgattatagtttccaaaatac

SEQ ID NO: 205884 - DNA, 601 bp, Human
tatatagtaaccaataatattcgcaaggtattttcactcacatttaatgtatggtggctaaaaaaacaaggactgaaaaacattttaatttaggaagttggaaaaagaaaccaagaacacagactgatcaggaattgggaaaaagggggtggtggtacagagatcttcttactgtttctaccactgggcaaggaaacctgagaattaactgatcctgttccccaattctaagcaaggactgccctcttagccctatgaggcctctgacttcaacgggggtacagtctgtgccaagtgaatracttgactccaaagtatcattcagatgcctaaggtcagttaatctcatcatgcttcccatcattgccatccttggcaactatccaaaatacagtctctacatctatacttctaaatttttctctgtatttctttccctcatacaatttccttcttgctgttctccctccatccttttcattgaggccttcagaattcctattataagattttgttttaatctatcccacaaaccctacacacaatctctttttttgttgttttcttggcagagtctcgcatcgtcgccggggctggaatg

SEQ ID NO: 205885 - DNA, 438 bp, Human
gtgtgagccccgcacctggcaaaaaaattttttaataaagaaaattttaagacaaataacccaattataaaataagcaaaggatttgaaaatatattcatcctcggctgggtgtggtagctcatgcctgtcaccctakcaccctgggaggccaaagcgggtagactgcttgagctcaggagttaccagcctgggcaacatggcgaaaccctgtctctatattaaaatatacatgtattttctatattaaaatatattttacatatgtaaagtatatgtttatatattaaaatgtatatttattaaaatatatatattttttcatccaaagaatatatacactgctgatgaaactgtaaaatggtacagctaaggccgggcgcagtggctcatgcctgtaatcccagcactttgggaggatgaagtgggacaatcacct

SEQ ID NO: 205886 - DNA, 601 bp, Human
gtgccccagtccatctgaggcacagcaagttgcataacatcattaccactttgcagggtctgccgtcctccagctaacactccactaggcaacatccctgtgggagtcaggcccttgagtgtcagcacactttcactctcctccctatagcagagagatataacaaatatcagatacttccaacaagtacttaatttaaaagaagacatagggtctagatataggccatatataaaattcatgacattcattgctattaccatattttcctcaatttcaagacattaatttttctatattktaagtgtttcaggtatgagggtgtgccttaccattgaggcatatattgtttttcctgaaaagctttattaaatatgtggtaagattcatcaaggggcatcatactattgagaaaatatggtatttcatatgctctgaagttcaaatgtctgatgtagtcagttgtgcaaacaaatttttaaagactgacctattcatttgtaccctttaacctggtcttcctgaattaaccccagggaaggcaatttatggctccagcacaagggacttcctatatggatgaacaagttcatcaagaata

SEQ ID NO: 205887 - DNA, 601 bp, Human
aagacagaaagaaaagaaagaaagaaagaaagaaagaaagaaagaaagaaagaaagaaaaagaaagagaagagaagagagaaaagaaaaaaaaagagcacttattatggaaccaagtgaaatgaaattgtgaagtcaaatgtaaattcattcaaaacgttaaaattgcctatttttttccctctaaaaaagtcactaattacaacaccaaaaagaaacctaattatgactaaggaaaacatcagatctgttgctattttaatagacaatgacccttagagggctgtcaaaagtgactacawgaaattcaggcttttccacatcatgtatttttgctttccaaccacaggaaaagaaatctagactgaattactgtgtatggtcactaatactcacatcactctcttctatttaatctgtaatgggcttttaaaaagttaacccagtatttacacaaatatttacgccaaaaaaagttttttaagtataaaatattcaatgagccagattacaggaatgctttacgtataattctttttattttcatgcaaaataaaggcacacttaataacaccctttcaattttgacttacaggatttaa

SEQ ID NO: 205888 - DNA, 601 bp, Human
tgcattttttgctatcaggaaaagcccaggaagctttctgaaagttgggtaaaaagacctggccttaggaaagcagcagagtggacatcaggaatgtgcacagggcgagggactgagatgattttacataaacgccaggaaagaaaatgccatggtcctttgttgagaaggaacaaagatcacagcaaacgaagatcctgaggatggtttagaaaagggtgaaagtgagtgcctagaagagcctgattttccccgcgggggtagattccaaagagcttccagggatagagatagaaggagmgtacggagcaatccgaaaggggtgaaggtgggcctggctcgggcttaggcccaaggatctccacctcttcccctggaaggtcccgacggcctctcccgcccaacattccgcccgggcgggggtgcacatggcaggccctagcccggctgtccccgagcggcgaacccggacggacgggtctcgcccttctcccggtccgtttcctggcctgatctctccgaggccgacaccgaggccaggggcccggagcaccgcccgccggtctctccttacctgcccagaccctgcagctggtccata

SEQ ID NO: 205889 - DNA, 601 bp, Human
agttgggaaacgcacaagacatgtgcttagcaaacgggatgccagagattgaagggaaagtagctcttccgcgggaaacaccgtgggatgcattttttgctatcaggaaaagcccaggaagctttctgaaagttgggtaaaaagacctggccttaggaaagcagcagagtggacatcaggaatgtgcacagggcgagggactgagatgattttacataaacgccaggaaagaaaatgccatggtcctttgttgagaaggaacaaagatcacagcaaacgaagatcctgaggatggtttagmaaagggtgaaagtgagtgcctagaagagcctgattttccccgcgggggtagattccaaagagcttccagggatagagatagaaggagcgtacggagcaatccgaaaggggtgaaggtgggcctggctcgggcttaggcccaaggatctccacctcttcccctggaaggtcccgacggcctctcccgcccaacattccgcccgggcgggggtgcacatggcaggccctagcccggctgtccccgagcggcgaacccggacggacgggtctcgcccttctcccggtccgtttcctggcctga

SEQ ID NO: 205890 - DNA, 601 bp, Human
attaagaagcagccaggctgccagaaaccatttctaggccacaccacaagtggcaaagatcccactttgccactctgaacacccaattagcacttgggcaaaggagaaaaaaggagtgggtgggcatggccttggaccacattgcaggttatgatggctatggcaaatgttggggtatttcctaaaataaaagcatgtgttctaagtactgagacagagtcgggatgaaagttgaacaggacactttctgcttttcagaagttgggaaacgcacaagacatgtgcttagcaaacgggatgmcagagattgaagggaaagtagctcttccgcgggaaacaccgtgggatgcattttttgctatcaggaaaagcccaggaagctttctgaaagttgggtaaaaagacctggccttaggaaagcagcagagtggacatcaggaatgtgcacagggcgagggactgagatgattttacataaacgccaggaaagaaaatgccatggtcctttgttgagaaggaacaaagatcacagcaaacgaagatcctgaggatggtttagaaaagggtgaaagtgagtgcctagaagagcctgattttcccc

SEQ ID NO: 205891 - DNA, 601 bp, Human
gattaagaagcagccaggctgccagaaaccatttctaggccacaccacaagtggcaaagatcccactttgccactctgaacacccaattagcacttgggcaaaggagaaaaaaggagtgggtgggcatggccttggaccacattgcaggttatgatggctatggcaaatgttggggtatttcctaaaataaaagcatgtgttctaagtactgagacagagtcgggatgaaagttgaacaggacactttctgcttttcagaagttgggaaacgcacaagacatgtgcttagcaaacgggatrccagagattgaagggaaagtagctcttccgcgggaaacaccgtgggatgcattttttgctatcaggaaaagcccaggaagctttctgaaagttgggtaaaaagacctggccttaggaaagcagcagagtggacatcaggaatgtgcacagggcgagggactgagatgattttacataaacgccaggaaagaaaatgccatggtcctttgttgagaaggaacaaagatcacagcaaacgaagatcctgaggatggtttagaaaagggtgaaagtgagtgcctagaagagcctgattttccc

SEQ ID NO: 205892 - DNA, 601 bp, Human
cagcactttgggaggtcgaagtgggtggatcacctgagatcagaagtttgagacccacacctgtaattccagctactagggaagctgaggcagaagaattctctaaatctgggaggcagagttgcctgggtgacagagttgagaccttgtctcaaaatgaaaaagaaaaatacaactactggtcatgacatgcaaggcaagcacttgctgcctttaacaaaatgacaccaaggtgtccatctcacaaaaggcagcagggtgaaggagacactgttcagcattactaatatgccagctcagctgacgcagacccacccacccatagctcatgtgtctatacagccttatggaaagtgaggtgttacagcccttgctcaccacactgctacaagtgataatcctatccccagttctatattaaattacattctacatacagaagcctacattacattttaagacttgctcttgcagttcctttaacctaaaggatctttgcaccaatggtcttatctgtacaaatacagataaactctgcagtaatatgaattcatgaagaatgaaatgcactggcaatttcctccatagcagcatcactgaa

SEQ ID NO: 205893 - DNA, 601 bp, Human
cactaaacaaagtacctgggtctttatttaagtcaggcaacaaatattcatggcttgtacttttgccagaattgatgttacgtctattagattgtcaaaaatgtcatgtttgtacaagtcttaatattttcatagcgtatttactgttttttctcctatttgcaaataacatcaagggaaataggatttgagaagagggtgaataaaactgattcatatcatgattgtttggttattcagatagaggtgacccagataactttctgtgagttccaaccatagaaacaataggtaccagatkttcttggcatagtttttaaacgttttaccttgtcaaatcatatgaggcttgaaaaatacaactactgaccaggcacagtggctcacacctgtgattccaatactttgggaggctgaggcaggctgatggcttgaggccacaagttcaaaacaagcctggggcaacatagtgagacttgactctaccaaagttaaaaaaaaaattagttgggtgtggtggcacgtgtctgtagtcccagctacttggggaggctggagtgggaggttcgcttgagctcggaaagttgaagctacagtgaac

SEQ ID NO: 205894 - DNA, 601 bp, Human
agcatagaagtttccattccatgggtttacagctaacctcacaaggtctacagtgcccccctcaacagggattacagtgccaaatcaatccccaaataacatttgcatcaaaagaacccttcctggtttaataaagctctgttagagatggaggacaaattcctccagaccgaacatcttgagtacttatgagactaaggaaaggctgggaatagtggctcttgcctataatcctagcactttgggaggccgaggcaggagtttgaaaccagcctgggcaacagagtgagacccccatgtytacaaaaaatacaaaaatcagccgggtgtgatggtgtgcacctatatatagtcccagctcctctggaagttgaggtgggaggatcacttgagccagggaagcagaggttgcagtgagccaagattttgccactgcactccagcctgggtgacagagcaagaccttgtctcaaaagagactaaagaaaagcagtttttactctctaaattaagtctcctatcaaggtcatgctggtagctaaggaacagataacaggtattagctcaaaataaacaaggaactaacttacaggtagggaat

SEQ ID NO: 205895 - DNA, 601 bp, Human
atcagaatggctcctcttcagagctggactacatcccaacagcttctgctatcaaagtaaaaaaggaaaataattaaggcacacaaataaaatttcagtggaaaattcagttctcaaaagaaaaaaaaggggggttgaatagggggtagactagctcctcacacactgcagtaggtaaccagtaaatgtggccaggaatccaccttgccaggacacagccaggacacagcatagaagtttccattccatgggtttacagctaacctcacaaggtctacagtgcccccctcaacagggattrcagtgccaaatcaatccccaaataacatttgcatcaaaagaacccttcctggtttaataaagctctgttagagatggaggacaaattcctccagaccgaacatcttgagtacttatgagactaaggaaaggctgggaatagtggctcttgcctataatcctagcactttgggaggccgaggcaggagtttgaaaccagcctgggcaacagagtgagacccccatgtctacaaaaaatacaaaaatcagccgggtgtgatggtgtgcacctatatatagtcccagctcctctggaagttga

SEQ ID NO: 205896 - DNA, 601 bp, Human
aatgatttgatgaccacacacagccctgagtagtcagtagcctttacagagaactcttgccagaagcaattcaccttataatgggtactagagatagcctcttgtgaagaacaaggtttcttttattagaaggttgcatcagtgaacaccgatcagcattgaggactgtgacagtatgagaatctgctgaaatgagttagggcaagcagatgcaaatctctataaagaccataaaatggcctagagaatgcacttatatataactccagttctgacaggggggaataaagggtaacttccytctataaaatctatcctcgttctttagacttgggatttaaatgctcagtttttaaacgaggaattactgtgtgccagatactacgatataatctttatacatataatccaatagaagcctcacaatacactaaaggtagctaatcctttcctttttctttagcaaatcaggaaactggtgcttaagaggttaccaagattatacacctcatctgtttgactccaaaatccaaactcttctcaccacactatctccctaggagaaaaccattcctggaattaaaatggcggtacctcatta

SEQ ID NO: 205897 - DNA, 601 bp, Human
aagcaagccccggggaactgctgttgctgttctttttcacatcacatgccttctccagaggtaattaattagtagaacaaataggaacacacacacacacacggtaccttcagattctctccatcgagaaggtccacgaagccatcatcctcatcagacaaagtggctgtcacaggtgactggggtgtaaaaagaggaatgaaattccctggttcactgctatctctttcatttgaggaaagctgtaagacaaaattcatggattaataatgagagctctgatccactttcatttccttgratgggtcactagtttttatgatgaaaacatactatgttatacttgttatacaaagcaaaattttagccattactgattatatgaaaatgtatcccaagattataaatgatttgatgaccacacacagccctgagtagtcagtagcctttacagagaactcttgccagaagcaattcaccttataatgggtactagagatagcctcttgtgaagaacaaggtttcttttattagaaggttgcatcagtgaacaccgatcagcattgaggactgtgacagtatgagaatctgctgaaatgag

SEQ ID NO: 205898 - DNA, 601 bp, Human
caagaaaagcctgctctccctaggcaaaggatggcctattgaggcagaagacttttagacaataatcattctactagtcaacacagaaacaattatggccaacagcaagcgggggcctccacctttgcccagctgtcatacagtgccccagtcaccaccccacggggatggaatgaacttccactccctcccagcaataatgagacaagtccccacccaaggtgtcaatggagtttgtgctggggaacccggacttccacccatgcctttcttgcagtatcagaggaagcctgctaaaacrtaaaatttacatagaccggagactcacaaatatacaggagacaatggaagaatcaccggtcataccaagaaccagaaaaatcccaacttgaacaggaaaagacaatcaacagatgccaacaacactatggatggatgttggatttgtcttacaaagattttaaagcagccatcttaaaaatgcttcaacaggcaattatgaacatactcaaagcaaatgaaaaaccaacatgaaaacagccaagtatcagccaggtgtggtggctcacacttgtaatcccagtgctttgggaggccaagg

SEQ ID NO: 205899 - DNA, 601 bp, Human
cgacagagcgagacttggtctcaaaaaaaaaaacaaacaaaaaaacacccagaaatttagccctgtatgatatgtttgtgtgaggaaaacaccccacaaactcaaagtgatttttcttattccctcactcaacagcaacagaagacagaagtgctgttacccccagatatgaggggatttctccctaccagcaagcaagcaagcaagcaagcagttctgcagtggaaaatagctgggtgccgtccaattcaattctgacactatctacctgcagagcgtcagatcaggaagttgagggccyagtcctcaaaaccacaccacccttcagacaccagttgggcctctggatcttctgatctacgaccaccagctttaagtaggggttcccatgaccccttctttgggtttaatttgctagaagtggctcacagaactcaagaaaacacatttaccagtttattatgaaggatattcaaaggatatagaagaagacatgcatagggtgaggtatgggagaagggacatggagctgccatgctctccttgggtgccccaacctccaggaacctccatgtgttcagctatccagaagctctctgaa

SEQ ID NO: 205900 - DNA, 601 bp, Human
agcccaggagttccagaccagatcaaagagcaagaccctgtccacacacacacacacacacacacacacacacacacacacacacacaagctgggcatggtggtgtgtgcctgtagtcccagctacttgggaggctgaagtgggaggatcacctgagcctggggaggtcgaggctacagcaagtggtgatggtgccactgcactccagcctgggtgacagactgaaactatctccagaaaaagagaaagaaacaaggggggttaaaactaggattaagtttagaaaaagtatgtcttaacttttttttttttttttttttaaaaagacagagtctcgctctgtcgctcaggctggagtgcagtggagtacaggagtggagtgcaggctggagtacagtgatcttggctcactgtaacctctgcctcccaggttcaagcgattctgccgcagcctccagagcagctgagactataggtgtgcgccaccacgcccagctaatttttgtatttttagtagagacggggtttcaccatgttggccagatggtcttgaactcctggcctcaggtgatctgcctgccttggcctcccaaagtgctgg

SEQ ID NO: 205901 - DNA, 601 bp, Human
gtccaaaatgttctcaatggttcctttgggggaagatgccagggataaagactgatgaagagtctgtaacaaatcaaaggtagagaatgagacaagggttctgaatggaacttctgaaaacattcacttggagcatgtctcgaggagactaaaatgttaatgcctacatttagtaagaagtttttattttattttattgaatctggagtgaacaaaaacagatgtgggttattgactaggtctcctattattccagtgtctaaccgaattgctctgaaactaagttttccttccttccttaaaaaaaaaaaaaaaaaaaagggggtgcaggtggtttggctcatgcctgtaatcccagcactttgggaggccaaggtgggttactcacttgagcccaggagttccagaccagcctgggcaaggcaggtgaatcgcttgagcccaggagttccagaccagatcaaagagcaagaccctgtccacacacacacacacacacacacacacacacacacacacacacacaagctgggcatggtggtgtgtgcctgtagtcccagctacttgggaggctgaagtgggaggatcacctgagcctggg

SEQ ID NO: 205902 - DNA, 601 bp, Human
aaagatacttagagaatctgaaagcctatatattattcacacttatactgttttgtctggctggtaggaggcatcttttaaaaaacaaacattaatggccaggcacggtggctcacacctgtaatcccagcactttgggaggccgaggctagtggatcacctgaggtcaggagttcgagacaagcctggccaacatggtgaaaccccaactcttttaaaaatacaaaaattagccgggcgttagcatgcacctatagtcccagctactcggaaggctggagtgggaaaatcgcttgaatcaaggaggcggaggttgcagtgagctgagattgcaccactgcactccagcctgggtgacagagcaagactccctctcaaaaaacaaacaaacaaacaagcaaacaaacattagttagtacacactagttactcttctagttacttcattaacatcctgacatttaattttcacacaaaccaatgaggtatattatccccattttgagcaccttatccaaggttacctagctagtaaggcagatttaaataaagaaacctcaggtaatctcattttcctcctgcttttgtcaagaatccacac

SEQ ID NO: 205903 - DNA, 601 bp, Human
acactattaatcgggtaaaacattaaaatggcaggccaggcgccgtggctcatgcctgtaatcctagcactttgggaggctgaggcgggcggtttgcctgagctcaggagtttgagaccagcccgggcaacatggtgaaaccccgtctctactaaaaaaaaaaaaaaattagccgggcgtggcagcgtgcacctgtagtcccagctacttggaaggctgaggcaggagaattgcttgaacccaggaggcagaggttgtggtgatccgagatcatgccactgcactccagcctggcgacagmgcggactctgtctcaaaaaaaaaaaaaaaaaaaagattaaaatggcaaaatcagttcctttcttcttgggaacgtgtgtcccaacacgcccctccaccaggcagcttgctgaacaatcaactttggaggcatcactaagcctggcacagacaccaggacatgttgccagagatggtcttctcctcatcaggagccctggggtgctcagacattggtacccaagcctcttaaatgctatgaaacccattcttgtcccccgaatgacttaaacatcagtgggtacctcctacaagtgtcctt

SEQ ID NO: 205904 - DNA, 601 bp, Human
tttgtgggtccgtacacgttcatcatacagtaatgcacatggggactggaaatgggcaattcaaatatgacaatggtacactttataggtagttttataaatttggggattttcaaaagccacaagacaatggcaaacagtaacatcgtatttaaagtacctccttactatatttaaacactattaatcgggtaaaacattaaaatggcaggccaggcgccgtggctcatgcctgtaatcctagcactttgggaggctgaggcgggcggtttgcctgagctcaggagtttgagaccagccsgggcaacatggtgaaaccccgtctctactaaaaaaaaaaaaaaattagccgggcgtggcagcgtgcacctgtagtcccagctacttggaaggctgaggcaggagaattgcttgaacccaggaggcagaggttgtggtgatccgagatcatgccactgcactccagcctggcgacagagcggactctgtctcaaaaaaaaaaaaaaaaaaaagattaaaatggcaaaatcagttcctttcttcttgggaacgtgtgtcccaacacgcccctccaccaggcagcttgctgaacaatcaactt

SEQ ID NO: 205905 - DNA, 601 bp, Human
gggacctctctcagaagaaaactcgcagtgaaacacaacaatgacacgcttgccatcagtaggtacaatgggcttcttcaataagaagtcttcaacctcttcttccatgtgcaagttcactgcaccctgtgaagacaacagagacccttggaacctgcacgtttcacacatgaagtaatgattcagcaagatgtaatgattcatcaagagtgatctttaagtccacaagaccagtttgtgatttttgcagttcttctagctgaatagcccagtagaccatttggcacctgtatctcaatgragctttgtgggtccgtacacgttcatcatacagtaatgcacatggggactggaaatgggcaattcaaatatgacaatggtacactttataggtagttttataaatttggggattttcaaaagccacaagacaatggcaaacagtaacatcgtatttaaagtacctccttactatatttaaacactattaatcgggtaaaacattaaaatggcaggccaggcgccgtggctcatgcctgtaatcctagcactttgggaggctgaggcgggcggtttgcctgagctcaggagtttgagacca

SEQ ID NO: 205906 - DNA, 601 bp, Human
gaagcaccttcttttttctgagacagaatctcactctgtcaccaggctggagtgcaagggcgtgacctcaggctcactgcaatctccgtctcccgggttcaagcaattctcctgcctcagcctcccaaatagctgggactacaggcgcgtgccaccgcccagctgatttttgtatgtttagtagagatggggcttcaccatgttggccaggatggtctcgacctcttgaccttgtgatccacctgccttggcctcccaaagtgttgggattacaggagttagccaccgcacccagtcaccttttttttttttttttgagatggagtctcactctgtcgcccaggctggagtgcactggcgcgatctcggctcactgcaacctctgcctcctgggttcaagggatgctcctgcctcagcctccaaagtagctgggattacaggtgtccgccaccacgcctggctaatttttgtatttttagtagagacgggatttcaccatgttggccaggctggtctcgatctcctgtccactccgaaatgtaagttccatgaaggcagagattttttggtctgttttgttcactgctcttctccctcagt

SEQ ID NO: 205907 - DNA, 601 bp, Human
ttattacagaattttcaagtaaaataacaataagataccactacacatctattagaatggataaaataaaaaacactgaaaaaaattaacagctgacaaagatattgaaaaacctacactaacattcattgtgggaatgcaaaatggtacagtctctttgaaacacagttcagcctttccttataaaactttaagcacactcttaccatacgatccagcaattgtgatccttggtatttacccaaatgagttgaaaacttatgtacacacaaaaacctgcacacaaatgcttatagcactkcattaataactgtcaaaacttggaagcaaacaagatgtccttcaatagataaatgcataaatgaattgtggcgtgttcatatcagaaaacagcattcaacaataaaaagaaataaactagtacaaaaagacatggaggaaacttaaatacatgttagtgaaataagtcaatctaaaaaggctacatattgtatgattctatctgtatgacattctaaaaaagaacaaatgatggagacagccaaaaagattagtggctgccagtggttcaagtggagggagagagggataaacaggtgga

SEQ ID NO: 205908 - DNA, 601 bp, Human
gcagaaaacattggcaaaacatatatcttgataaaggattgctacccaaaatacacaaagaactcttaaaactcaataataatgaaacaatccaattaaaaagtgggcaaaagacctgaacagacatcttaccaaagaagatgttcatgtagcaaataagcacatgaaataatgctcaacatcatatgttattacagaattttcaagtaaaataacaataagataccactacacatctattagaatggataaaataaaaaacactgaaaaaaattaacagctgacaaagatattgaaaaamctacactaacattcattgtgggaatgcaaaatggtacagtctctttgaaacacagttcagcctttccttataaaactttaagcacactcttaccatacgatccagcaattgtgatccttggtatttacccaaatgagttgaaaacttatgtacacacaaaaacctgcacacaaatgcttatagcacttcattaataactgtcaaaacttggaagcaaacaagatgtccttcaatagataaatgcataaatgaattgtggcgtgttcatatcagaaaacagcattcaacaataaaaagaaa

SEQ ID NO: 205909 - DNA, 601 bp, Human
attgtaggttctcactgatatgtgggagctaagctatgaagacacaaaggcatgagaatgatacaatgggctttggggacttggggggaagagtgggagcgggggtgaggaataaaagactacaaatgtggtgcagtgtatactgctcaggttatgggtgcaccaaaatctcacaaatcaccactaaaggaatttactcatgtaaccaaataccacctgtaccctaataacttatgggggaaaaaaagtttacacctaaggccaattttcagcacagaggtagtctacaacaatcaaaacmaaaacaaacaaacaaacaaacaaacaaaaaccagtaaatcctgaagatgggcgagaatctacttttcacagttactatattattagtgatagaactctaaggagaaacagataaactcacccttatagttggagactttgtcacccctttgtcagaaatggacaggtccagcagtcagaaaataggtaaggatataattgaatggaaaagtaccatcaattaactggatcaaatcaatatttgtaaaatatttcatccaatgacagcagaatatattttctttctcacgctcacaatcaa

SEQ ID NO: 205910 - DNA, 601 bp, Human
aatcaacgaataaataaagaaactgtggtatatatacatacaatggaatactactcagccataaaaagtaatgaattaacagcattcgcagtgacctggataagattggacacattctaagtgaagtagctcaggaatggaaaaccaaacattgtaggttctcactgatatgtgggagctaagctatgaagacacaaaggcatgagaatgatacaatgggctttggggacttggggggaagagtgggagcgggggtgaggaataaaagactacaaatgtggtgcagtgtatactgctcagkttatgggtgcaccaaaatctcacaaatcaccactaaaggaatttactcatgtaaccaaataccacctgtaccctaataacttatgggggaaaaaaagtttacacctaaggccaattttcagcacagaggtagtctacaacaatcaaaacaaaaacaaacaaacaaacaaacaaacaaaaaccagtaaatcctgaagatgggcgagaatctacttttcacagttactatattattagtgatagaactctaaggagaaacagataaactcacccttatagttggagactttgtcaccccttt

SEQ ID NO: 205911 - DNA, 601 bp, Human
tgggacctaattaaactaaagagcatttgcatggcaaaaggaacagtcagcagggtaaacagacaacccacagagtgggaggaaatcttcacaatctatacatctgacaaaggactaatatctagaatctacaatgaactcaaacaaatcagtaacacgataaacaaacaatcccatcaaaaactgggctaaggacatgaatagacaattctcaaaagaagatatacaaatggccaacaaacatataaaaaaatgctcaacatcactaataatcagggaaatgcaaatcaaaaccacaatrcaataccaccttactcctgcaagaatagccataatcaaaaaatcaaaaacattagatgttggcatggatgtggtgatccaggaacacttctacactgctggtaggaatgtaaactagtatagccactatggaaatctgtgtggagattcctaaaagaactaaaagtagaactaccatttgatccagcaatcccactactgggtatctacccagaggaaaataagtcattattagaaagagatacttgcacatgcatgtttaaagcagcacaattcacaattgcaaaatcgtggaaccaac

SEQ ID NO: 205912 - DNA, 601 bp, Human
atgaccaagaacccaaaagcaaatgcaataaaaacagagataaatggctgggacctaattaaactaaagagcatttgcatggcaaaaggaacagtcagcagggtaaacagacaacccacagagtgggaggaaatcttcacaatctatacatctgacaaaggactaatatctagaatctacaatgaactcaaacaaatcagtaacacgataaacaaacaatcccatcaaaaactgggctaaggacatgaatagacaattctcaaaagaagatatacaaatggccaacaaacatataaaaaaatgctcaacatcactaataatcagggaaatgcaaatcaaaaccacaatacaataccaccttactcctgcaagaatagccataatcaaaaaatcaaaaacattagatgttggcatggatgtggtgatccaggaacacttctacactgctggtaggaatgtaaactagtatagccactatggaaatctgtgtggagattcctaaaagaactaaaagtagaactaccatttgatccagcaatcccactactgggtatctacccagaggaaaataagtcattattagaaagagatacttgcacat

SEQ ID NO: 205913 - DNA, 601 bp, Human
tagaccaatggaacagaatagagaacccagaaataaatccaatacttacaaccaactgatcttcaacaaagcaaacaaaaacataaagtgggggaaaggacacccttttcaactaatgttgctgggataattggctagccacatgtaggagaatgaaaccgcatcctcatctctcaccttatacaaaaatcaactcaagatggattgaggacttaaacctaagacctgaaactataaaaattctagaagataacattggaaaaacccttgtagacattggcttaggcaaggatttcatgamcaagaacccaaaagcaaatgcaataaaaacagagataaatggctgggacctaattaaactaaagagcatttgcatggcaaaaggaacagtcagcagggtaaacagacaacccacagagtgggaggaaatcttcacaatctatacatctgacaaaggactaatatctagaatctacaatgaactcaaacaaatcagtaacacgataaacaaacaatcccatcaaaaactgggctaaggacatgaatagacaattctcaaaagaagatatacaaatggccaacaaacatataaaaaaatgct

SEQ ID NO: 205914 - DNA, 601 bp, Human
agattgtcactgtttgctgccaatatgattgcttgccttgaaaatcctaaagactcctccagaaagctcctaaaactgataaaagaattcagcaaagtttctggatacaagattaatgtacacaagtcagtagctcttctatacaccaacagcaaccaaactgagaatcaaatcaagaacccttttataatagctaaaaaaaaaaaaaaaaaaaaaccttaggaatatacctaaccaaggagttgaagacctctaccaggagaactacaaaacattgctgaaagaaatcatagacggggcygggcctggtggctcacacttgtaatcccagcactttgggaggctgagatgggcggatcacaagttcaggagatcaagaagatgctggcgaacatggtgaaaccccatctctactaaaaaatacaaaaaaattagccaggcgtggtggcaagtgcctgtagtcccagctactcaggaggctgaggcaggagaatggcatgaacctggaaatgtgaaggttgcagtgagccgagatcatgccactgcactccaccctgggtgacagagcgagactccatctcaaaaaaaaaaaaaaaagaaa

SEQ ID NO: 205915 - DNA, 601 bp, Human
gaagtcagattgtcactgtttgctgccaatatgattgcttgccttgaaaatcctaaagactcctccagaaagctcctaaaactgataaaagaattcagcaaagtttctggatacaagattaatgtacacaagtcagtagctcttctatacaccaacagcaaccaaactgagaatcaaatcaagaacccttttataatagctaaaaaaaaaaaaaaaaaaaaaccttaggaatatacctaaccaaggagttgaagacctctaccaggagaactacaaaacattgctgaaagaaatcatagayggggccgggcctggtggctcacacttgtaatcccagcactttgggaggctgagatgggcggatcacaagttcaggagatcaagaagatgctggcgaacatggtgaaaccccatctctactaaaaaatacaaaaaaattagccaggcgtggtggcaagtgcctgtagtcccagctactcaggaggctgaggcaggagaatggcatgaacctggaaatgtgaaggttgcagtgagccgagatcatgccactgcactccaccctgggtgacagagcgagactccatctcaaaaaaaaaaaaaa

SEQ ID NO: 205916 - DNA, 601 bp, Human
taatccaccatgatcaagtgggtttcataccagggatgcagggatggtttaatgtatacaagtaaataaatgtgatacaccacagaaagagaattaaaaacaaaaatcacatgatcatctcaatagatgcagatgcagaaaaagcatctgacaaaacccagtattcctttatgattaaaactttcagcaaaattggcataaagggacataccttaatataataaaatccatctacagcaaacccacagccaacataatactgaatggggaaaagttgaaagcattccctctgagaactggwacatgacaaggttacccactctcaccacttctttacaacatagtactggaaatcctagccacagcaatcagacaagagaaagaaataaagggcatccaaatcagtaaagaggaagtcagattgtcactgtttgctgccaatatgattgcttgccttgaaaatcctaaagactcctccagaaagctcctaaaactgataaaagaattcagcaaagtttctggatacaagattaatgtacacaagtcagtagctcttctatacaccaacagcaaccaaactgagaatcaaatcaagaaccct

SEQ ID NO: 205917 - DNA, 601 bp, Human
tggacacacttttagaaatgtgaaatgctctggaaagtctcagcaatagaattgaacaagtagaagaaagaaattcagagctcgaagacaaggtctttgaattaacccaatccaacaaagataaagaaaaaagaataagaaaatatgaacaaagcctccaagaagtctgggattatgttgaacccaagaataatcagtgttcccgaggaagaagagaattctaaaagcttggaaaacatatttgggggagtaattgaggaaaatttccccgacctggctagagacccagccatccaaatamaagaagcacaaacaacccttaggaaattcatggcaaaaagatcttcacctaggcacatcagattatccaaagttaagatgaaagaaagaatcttaaaagctgtgagacagaagcaccaggttacctacaaagaaaacctatcagattaacagcagatttctcagcagaaaccctacaagccagaagggattgggaccctatcttcagcctcctcaaacaaaacaattgtcagccaagaattttgtatccagctgaactaagcatcatatatgaaggaaagatacagtccttttcagacaa

SEQ ID NO: 205918 - DNA, 601 bp, Human
aaagcaatcaaaacttcaggaaactttggacacacttttagaaatgtggaatgctctggaaagtctcagcaatagaattgaacaagtagaagaaagaaattcagagcttgaaactttggacacacttttagaaatgtgaaatgctctggaaagtctcagcaatagaattgaacaagtagaagaaagaaattcagagctcgaagacaaggtctttgaattaacccaatccaacaaagataaagaaaaaagaataagaaaatatgaacaaagcctccaagaagtctgggattatgttgaaccyaagaataatcagtgttcccgaggaagaagagaattctaaaagcttggaaaacatatttgggggagtaattgaggaaaatttccccgacctggctagagacccagccatccaaataaaagaagcacaaacaacccttaggaaattcatggcaaaaagatcttcacctaggcacatcagattatccaaagttaagatgaaagaaagaatcttaaaagctgtgagacagaagcaccaggttacctacaaagaaaacctatcagattaacagcagatttctcagcagaaaccctacaagccaga

SEQ ID NO: 205919 - DNA, 601 bp, Human
gagcccaatgcaagaaaatccacaaaacaatacaagaagtaagaggagaaatattcaaggaaatagatgcataaagaaaaagcaatcaaaacttcaggaaactttggacacacttttagaaatgtggaatgctctggaaagtctcagcaatagaattgaacaagtagaagaaagaaattcagagcttgaaactttggacacacttttagaaatgtgaaatgctctggaaagtctcagcaatagaattgaacaagtagaagaaagaaattcagagctcgaagacaaggtctttgaattaacscaatccaacaaagataaagaaaaaagaataagaaaatatgaacaaagcctccaagaagtctgggattatgttgaacccaagaataatcagtgttcccgaggaagaagagaattctaaaagcttggaaaacatatttgggggagtaattgaggaaaatttccccgacctggctagagacccagccatccaaataaaagaagcacaaacaacccttaggaaattcatggcaaaaagatcttcacctaggcacatcagattatccaaagttaagatgaaagaaagaatcttaaaagctgtgag

SEQ ID NO: 205920 - DNA, 601 bp, Human
atatgtacatatatgtgaattcctattaaataaattacatttatatttatttatgttatatgtatgtgtgtacatatatgtatatatgagagagatagctgggaaagatagagatataatagagtactatgcgactttttttaacaaaattatacttttatataatatataatgacctgaaaaaaatgcttgtaatatttgatgtaaagaaagaaaatctgactaggcatggtggctcatgcttgtaaccccaacactttgggaggccaaggcagatggatcacttgaggtcaggatttcsagactagcctggccaacactttgggaggccgaggcaggcagatcacaaggtcaggagattgaggccatcccggctaacacggtgaaaccgtgtctctactaaaaatacaaaaaaattagccaggcatggtggcacacgcctgtagtcccagctacttgggaggctggggcaggagaattgcttgaatctgggaggcagaggttgcagtgagccaagatcgcgccactgcactccagcctgggcgacagagcgagactccatctcaaaaagaaaaaaagaaaaagaaaaaaaattgattca

SEQ ID NO: 205921 - DNA, 601 bp, Human
tgatctctgtacgctgcagccctcttccctccaacaagaaaggcagcatgcccagaagtacctgcctggatatcccctgacacagctcctgtgttctctctcagcaacaggctttccaaatcccctctaggaagtttatttgcgccctctacccatgtatatatgcattgttctcatcaaatggcgtggagatgggaacatacctgtcttccccaccaagaaccatgccatgaggaaagggaccatggctcgccacacacctccagggctggtacggtgccggtgcatggggcagtctacrgcaaaaaagtgattctcctctctgatccgatacctacaattggcccacatctgtggcttctatcagcagaatgttctggaattttggtctttagggcaaaattccaacagaggcatattaatttggtccttccatcttcctcaaagaaaataaaatttgattttgtttctcttaatgaaatgtgtagtcttctctttcgtgcttctgcctcctccaccagctccttcacatgcacagataaatctctctctcagcacatctccctcggcccaacttgctccagcaatggcactatttact

SEQ ID NO: 205922 - DNA, 601 bp, Human
agttaaagacaacaaacaaggtgcatttcctggaatgtcctgtgcttttctgatctctgtacgctgcagccctcttccctccaacaagaaaggcagcatgcccagaagtacctgcctggatatcccctgacacagctcctgtgttctctctcagcaacaggctttccaaatcccctctaggaagtttatttgcgccctctacccatgtatatatgcattgttctcatcaaatggcgtggagatgggaacatacctgtcttccccaccaagaaccatgccatgaggaaagggaccatggctygccacacacctccagggctggtacggtgccggtgcatggggcagtctacggcaaaaaagtgattctcctctctgatccgatacctacaattggcccacatctgtggcttctatcagcagaatgttctggaattttggtctttagggcaaaattccaacagaggcatattaatttggtccttccatcttcctcaaagaaaataaaatttgattttgtttctcttaatgaaatgtgtagtcttctctttcgtgcttctgcctcctccaccagctccttcacatgcacagataaatctctctc

SEQ ID NO: 205923 - DNA, 601 bp, Human
agtcttcaattttaagggatctacagcccctttgagaatataatgaagaccatgtggctacatcccagaaggacgcatatagtcattatgcacatgcccagttataaccacaagggcacagctgggcagtgagacaaggctcaggctccaacccctctcctatgagggcccagactctctccagctttacaatcctttggctgccagttaaagacaacaaacaaggtgcatttcctggaatgtcctgtgcttttctgatctctgtacgctgcagccctcttccctccaacaagaaaggcascatgcccagaagtacctgcctggatatcccctgacacagctcctgtgttctctctcagcaacaggctttccaaatcccctctaggaagtttatttgcgccctctacccatgtatatatgcattgttctcatcaaatggcgtggagatgggaacatacctgtcttccccaccaagaaccatgccatgaggaaagggaccatggctcgccacacacctccagggctggtacggtgccggtgcatggggcagtctacggcaaaaaagtgattctcctctctgatccgatacctacaattggcc

SEQ ID NO: 205924 - DNA, 601 bp, Human
gtgtgtgtgcacgtgtgtgtgtgcatacacacatgtgcaatgcacagagcagagcaagcgcagtagagatgagtctccctccagcagggcccagactgcccaaggcactcatggaatgcttctttcagaacagactttggcatcagttaagagtcacactaggattttgagcaagagtatcatttaccagctttaatccgctgcctttctctttctgaatgatactgttcccaaagattaattaaatcctcaggaggtcatgagaaaacactgctgacattgaaaataattttaaaagggwtgttctgagaaagcattgagtgctgtcagtcacacaacccagaaaatacgggctaggagtcactgcggcctctcccgagctctgaggaccttgtggtgccacgatcgcactggcacagcctgactgtgttgtccccacacacatgtctgtctctccctccagacccatgatgctcccaaagccagggaccctgtctcattgttttgtgttgggctgagcatttgcactttgctggacattgcatagatgctgaaacctattgctgaattgaaacagctctctccaaaggatcaaaacgca

SEQ ID NO: 205925 - DNA, 601 bp, Human
ggaccgacttctaagagattgtcaaaggagcagcatgttgtggtccccagggtggcaaccatctagagggtaaaaagcagacagccttttattccccaggtgccagtcaccgctgtaacctccacacaagcaactgctgccccatggtccaacctggggccatgagccgagatcccaatgaatgtctgctacatggaaacgtaagcccatggatgcacattgaatctttgggtgaaagcatcataacaggttaagagaaacagatttgcagacagaaaactaagctctgaggttagaaacygggaagttgcaaaagattttccagggtgccttggggcagacatgaagcaatctaccacctggacaatgatacctatattctactttagtaaatatacatatactatattctactttattaaatatacatatatatgtatgtgtgtatatttttgttaaattttaattaacgttctatgtaacattagtgtaactatgttcttatattccatatatacattttaatttaattataatctaattaaatttataattaagttataattaaaatatacacaagtgtatatattttattttctat

SEQ ID NO: 205926 - DNA, 601 bp, Human
gtcatctccatggtccagcgggcagcccacacttggcccaggggacagcaggccatgtgggctctatccagcagaagacctcggccctttaaatccgatagccctagggaattacatcagccagctactggccaggacattcagttcttagcctgacatctgagtcagaggactccaagttgcttggctgagctgatgaaggtttgcagctgatgaggccaatgctgtggctgcagtcctgagtcagccagttctatcccttctccccagcccggggctgtgcacgaccacttcccgccasttgttcttacagctgtgtgccacagagcataaacggtggagcataaaccctgtgagagcgggtaagtctatgccacccacctcccagtagttcccagcactgcattccttgctgtgcagcaatgcactctacctttgggatggtgcattttccctgcattaatttatcctctgaataatcgtgtggggaaatcttgttattttatgagcacaagtggggtttttctcttcactttacagacagcataaatgaagctcagaatgtaagattcaggggtggatcctgggctgcaccctagct

SEQ ID NO: 205927 - DNA, 601 bp, Human
gtgactggcaggtgacacacgctggctgtcatctccatggtccagcgggcagcccacacttggcccaggggacagcaggccatgtgggctctatccagcagaagacctcggccctttaaatccgatagccctagggaattacatcagccagctactggccaggacattcagttcttagcctgacatctgagtcagaggactccaagttgcttggctgagctgatgaaggtttgcagctgatgaggccaatgctgtggctgcagtcctgagtcagccagttctatcccttctccccagcccrgggctgtgcacgaccacttcccgccacttgttcttacagctgtgtgccacagagcataaacggtggagcataaaccctgtgagagcgggtaagtctatgccacccacctcccagtagttcccagcactgcattccttgctgtgcagcaatgcactctacctttgggatggtgcattttccctgcattaatttatcctctgaataatcgtgtggggaaatcttgttattttatgagcacaagtggggtttttctcttcactttacagacagcataaatgaagctcagaatgtaagattcag

SEQ ID NO: 205928 - DNA, 601 bp, Human
cacagctcccctgctttgctacctccttctcttagaaacactgccaaagactgcctctcaggaccctctatggcattcaaagctgagttcttggggagaagagacttcctaccctatgagccaccaccaacaatgaaatcccgcttgagtctgaaataacacaccacagtatatcaataaggtcatttttttgtgttaagtctgtaccaatttacattctgttgctttttggagaagcggagtgctggtcaataattttgattgctacttctcaaaagaagcaggcatttcacttagcatyaaagatcatgctttacaatttccagaagactgtctaggggcatttaaatgcattggtagcttctcgttcaatattggttaaagtgaatatcatgttcagatgtatgggcagaacatgactgtcatattgaaccagattgtatggaattgcgggttggtattttaaattactcttttgagtttaagttcattaagattttattttgttcctactttcccacagttttataagctaacatttattctttctgtttgggatttgtgtagattgaaatggaactgtaagtgtcaggagtatttc

SEQ ID NO: 205929 - DNA, 601 bp, Human
tgtttttaagcccttaaaacatgattaactcatctactcctggcgacaatcccacaccggatgtattcttatgaaatctattttctggaggatagggaggatatctaactcgcccaagggtacacagctagtcttaaggataaatctaggattcaaaccaaggagtctaatgcagagaactgtgcccttcatctgccatcacacatgggtgaggtctcacgacacctcctgccccttggcagaaagcatttctttcttggccagtgccacagctcccctgctttgctacctccttctcttrgaaacactgccaaagactgcctctcaggaccctctatggcattcaaagctgagttcttggggagaagagacttcctaccctatgagccaccaccaacaatgaaatcccgcttgagtctgaaataacacaccacagtatatcaataaggtcatttttttgtgttaagtctgtaccaatttacattctgttgctttttggagaagcggagtgctggtcaataattttgattgctacttctcaaaagaagcaggcatttcacttagcattaaagatcatgctttacaatttccagaagactgt

SEQ ID NO: 205930 - DNA, 601 bp, Human
aatagtgattagcaaacctgacatgcaagcagaggaagctgtcaagggaaagtttttctaagacgtagtagaaaatcacaaaagcacctaatgcaatttcagtatttactgtctgccaggcactgtttttaagcccttaaaacatgattaactcatctactcctggcgacaatcccacaccggatgtattcttatgaaatctattttctggaggatagggaggatatctaactcgcccaagggtacacagctagtcttaaggataaatctaggattcaaaccaaggagtctaatgcagagractgtgcccttcatctgccatcacacatgggtgaggtctcacgacacctcctgccccttggcagaaagcatttctttcttggccagtgccacagctcccctgctttgctacctccttctcttagaaacactgccaaagactgcctctcaggaccctctatggcattcaaagctgagttcttggggagaagagacttcctaccctatgagccaccaccaacaatgaaatcccgcttgagtctgaaataacacaccacagtatatcaataaggtcatttttttgtgttaagtctgtaccaat

SEQ ID NO: 205931 - DNA, 601 bp, Human
cagacataaaccagaatactacttcattgattagtagtaagaggattattctttccaaagatggggacatttgtattctatacctctggtaccctcttttctggtattacagcattatgagaattcaaagttgtaattagaatagtgattagcaaacctgacatgcaagcagaggaagctgtcaagggaaagtttttctaagacgtagtagaaaatcacaaaagcacctaatgcaatttcagtatttactgtctgccaggcactgtttttaagcccttaaaacatgattaactcatctacycctggcgacaatcccacaccggatgtattcttatgaaatctattttctggaggatagggaggatatctaactcgcccaagggtacacagctagtcttaaggataaatctaggattcaaaccaaggagtctaatgcagagaactgtgcccttcatctgccatcacacatgggtgaggtctcacgacacctcctgccccttggcagaaagcatttctttcttggccagtgccacagctcccctgctttgctacctccttctcttagaaacactgccaaagactgcctctcaggaccctctat

SEQ ID NO: 205932 - DNA, 601 bp, Human
cctaagtagctgggactacaggcgtgtgccaccacacacagctaatttttaaaattttgtttgtagagacagtgtgtctcattacgttgcccaggctgatctcgaactcttgggcttaagccgtcctcttgcctcagcctcccaaagtactgggattacaggtgtgagccactgcaccccgaccagctcctttatttttaaagttcattgtattcctaacagctacaggctcccgtagctggaagatcctgggtaaaaactgtgaacaaccggctctggctgcatgcatcagtgttagggkctaccttattttcaaggagaaaataagaggtttaaaccaccaagagtggcagaggaggacactctgcattttccctgagctgtcataaatggtgctttctttttcaaatgcatgtcctggtttatcacctgactggtgaacaggaacagggtccaccttaatggccagggatttggccatgcggctggattcataattgataccgaaataaaggtggctgttgcagtgaggcgccagtctggccgactctcctactgggaaacttttcagtcttcccaaggccctagggcacctcctgtc

SEQ ID NO: 205933 - DNA, 601 bp, Human
ttttttttgagcgacagggtcttactttgttgcccaggctggacatgaacacagctcactgcagcctcaacctcccaagctcaagtgatcctcctgccttagcttcctaagtagctgggactacaggcgtgtgccaccacacacagctaatttttaaaattttgtttgtagagacagtgtgtctcattacgttgcccaggctgatctcgaactcttgggcttaagccgtcctcttgcctcagcctcccaaagtactgggattacaggtgtgagccactgcaccccgaccagctcctttatytttaaagttcattgtattcctaacagctacaggctcccgtagctggaagatcctgggtaaaaactgtgaacaaccggctctggctgcatgcatcagtgttagggtctaccttattttcaaggagaaaataagaggtttaaaccaccaagagtggcagaggaggacactctgcattttccctgagctgtcataaatggtgctttctttttcaaatgcatgtcctggtttatcacctgactggtgaacaggaacagggtccaccttaatggccagggatttggccatgcggctggattcata

SEQ ID NO: 205934 - DNA, 601 bp, Human
gactcagattgctaaaacttagcattacactaagactggttacgaatctaagaatgaaaacacaagctactgaattagaagtgtgtacttgcatttgttttctgtcaatgctggataaatcaaataaaaaattgtcctttttaggcttctcatttcttatgccagtatgttgcaatgatattccctagataaaagtttccagtgaggctaagaattagcaataattccatcaagggttcagaaaaggcagcaagcagtgagctaagtgactattgcacccctttggctctggcatcttccytgccagcttctttcactgtcacctcggacaggcaactgacatctgtgagcagggaaacttaccacatggcagaacagtcaaaattcaccaatagccatttgtggggattaaagttgaatgaatctgcaaactgccaaagaacaagagtaagaaaaagaaaacattttctttataaatgtttaattataaagaagaccccatacatgataataaaagtttatggcacaactaatccacagtggtaggggccaggtagggttgcccaggggagtagtaacttgtagtgggtaggggagtctt

SEQ ID NO: 205935 - DNA, 601 bp, Human
tcgaataaagggacctctggcacacggtgcaaactgtcctcactgtgttccaccttgggtgaaacagaaaaacacaaccacaagaatacaaaagaatactcacattcataacggccatgtctttcataaatacttatttcagacaaaattaagtctgaaatgcccacataccaactggttttaaaattatatagcagaagtttggggaaaaagactgacaaaaaataatttgatttgtatacaagtaaaggactagaaatgtggttagccttaaaaaaaaaacaggaaaaggtcaaacggrtattttggtaaccttgagagctgacattagttgttttgtataaaagctgctttcctcatgcttaggaggaaagtgaaaagttattcacttaattacatactgaacaattttgcaaagccttctgaatatttggaaaattttgcagttttgcatactgtacaaaattcatgcaaatcctcctggccctatgatcaatcaatcaacttcttactttaaaactttagagaaactagtttctagtgtccctgtatcactgcccatcatcattatttctttaaacattgtgtaggtggtgtaata

SEQ ID NO: 205936 - DNA, 601 bp, Human
tttcaatcaaaattacccctcgaataaagggacctctggcacacggtgcaaactgtcctcactgtgttccaccttgggtgaaacagaaaaacacaaccacaagaatacaaaagaatactcacattcataacggccatgtctttcataaatacttatttcagacaaaattaagtctgaaatgcccacataccaactggttttaaaattatatagcagaagtttggggaaaaagactgacaaaaaataatttgatttgtatacaagtaaaggactagaaatgtggttagccttaaaaaaaaaacaggaaaaggtcaaacggatattttggtaaccttgagagctgacattagttgttttgtataaaagctgctttcctcatgcttaggaggaaagtgaaaagttattcacttaattacatactgaacaattttgcaaagccttctgaatatttggaaaattttgcagttttgcatactgtacaaaattcatgcaaatcctcctggccctatgatcaatcaatcaacttcttactttaaaactttagagaaactagtttctagtgtccctgtatcactgcccatcatcattatttctttaaaca

SEQ ID NO: 205937 - DNA, 601 bp, Human
tacacagcatctcaccaaattctttgactcttgttctgtcgagaacgcaccggctcaggagagaaagagcacattctctattgcaatttaaaaacatattttgtagcctttcaagcccataggaaggtaagaggttcctcaagtattgcaaccaccctgacccaccactgtcgcccactccagaggatgggaactaaccccatcacccttctcttgtggcagacttccagacaccgcaggcctctcttgtgtcttagggcttacgtttaattccttctacaaggaaattttccaaatggccttttccaaatggcctggcctcatccctgtgtgtcctgtgtctcttccctacatcacctccactttgtcaaatttcccctcacaggctggtggctgaactgaaccccgagcgccggggaagagttgtccgggagagatgagcgcacagccgccaacttgctggcatcagctctgcagcgtctgcggcagcctcggggcatcagctctgcggcaggcactccacgtcccgaaaggctcaactccttctcaccaccgcactgactaagcaggttttcttcagccttaacatacgcactggttg

SEQ ID NO: 205938 - DNA, 601 bp, Human
ggtacacagcatctcaccaaattctttgactcttgttctgtcgagaacgcaccggctcaggagagaaagagcacattctctattgcaatttaaaaacatattttgtagcctttcaagcccataggaaggtaagaggttcctcaagtattgcaaccaccctgacccaccactgtcgcccactccagaggatgggaactaaccccatcacccttctcttgtggcagacttccagacaccgcaggcctctcttgtgtcttagggcttacgtttaattccttctacaaggaaattttccaaatgkccttttccaaatggcctggcctcatccctgtgtgtcctgtgtctcttccctacatcacctccactttgtcaaatttcccctcacaggctggtggctgaactgaaccccgagcgccggggaagagttgtccgggagagatgagcgcacagccgccaacttgctggcatcagctctgcagcgtctgcggcagcctcggggcatcagctctgcggcaggcactccacgtcccgaaaggctcaactccttctcaccaccgcactgactaagcaggttttcttcagccttaacatacgcactggt

SEQ ID NO: 205939 - DNA, 601 bp, Human
aggtacacagcatctcaccaaattctttgactcttgttctgtcgagaacgcaccggctcaggagagaaagagcacattctctattgcaatttaaaaacatattttgtagcctttcaagcccataggaaggtaagaggttcctcaagtattgcaaccaccctgacccaccactgtcgcccactccagaggatgggaactaaccccatcacccttctcttgtggcagacttccagacaccgcaggcctctcttgtgtcttagggcttacgtttaattccttctacaaggaaattttccaaatsgccttttccaaatggcctggcctcatccctgtgtgtcctgtgtctcttccctacatcacctccactttgtcaaatttcccctcacaggctggtggctgaactgaaccccgagcgccggggaagagttgtccgggagagatgagcgcacagccgccaacttgctggcatcagctctgcagcgtctgcggcagcctcggggcatcagctctgcggcaggcactccacgtcccgaaaggctcaactccttctcaccaccgcactgactaagcaggttttcttcagccttaacatacgcactgg

SEQ ID NO: 205940 - DNA, 601 bp, Human
ccaggtacacagcatctcaccaaattctttgactcttgttctgtcgagaacgcaccggctcaggagagaaagagcacattctctattgcaatttaaaaacatattttgtagcctttcaagcccataggaaggtaagaggttcctcaagtattgcaaccaccctgacccaccactgtcgcccactccagaggatgggaactaaccccatcacccttctcttgtggcagacttccagacaccgcaggcctctcttgtgtcttagggcttacgtttaattccttctacaaggaaattttccaamtggccttttccaaatggcctggcctcatccctgtgtgtcctgtgtctcttccctacatcacctccactttgtcaaatttcccctcacaggctggtggctgaactgaaccccgagcgccggggaagagttgtccgggagagatgagcgcacagccgccaacttgctggcatcagctctgcagcgtctgcggcagcctcggggcatcagctctgcggcaggcactccacgtcccgaaaggctcaactccttctcaccaccgcactgactaagcaggttttcttcagccttaacatacgcact

SEQ ID NO: 205941 - DNA, 601 bp, Human
tccaggtacacagcatctcaccaaattctttgactcttgttctgtcgagaacgcaccggctcaggagagaaagagcacattctctattgcaatttaaaaacatattttgtagcctttcaagcccataggaaggtaagaggttcctcaagtattgcaaccaccctgacccaccactgtcgcccactccagaggatgggaactaaccccatcacccttctcttgtggcagacttccagacaccgcaggcctctcttgtgtcttagggcttacgtttaattccttctacaaggaaattttccawatggccttttccaaatggcctggcctcatccctgtgtgtcctgtgtctcttccctacatcacctccactttgtcaaatttcccctcacaggctggtggctgaactgaaccccgagcgccggggaagagttgtccgggagagatgagcgcacagccgccaacttgctggcatcagctctgcagcgtctgcggcagcctcggggcatcagctctgcggcaggcactccacgtcccgaaaggctcaactccttctcaccaccgcactgactaagcaggttttcttcagccttaacatacgcac

SEQ ID NO: 205942 - DNA, 601 bp, Human
atttttccaggtacacagcatctcaccaaattctttgactcttgttctgtcgagaacgcaccggctcaggagagaaagagcacattctctattgcaatttaaaaacatattttgtagcctttcaagcccataggaaggtaagaggttcctcaagtattgcaaccaccctgacccaccactgtcgcccactccagaggatgggaactaaccccatcacccttctcttgtggcagacttccagacaccgcaggcctctcttgtgtcttagggcttacgtttaattccttctacaaggaaattktccaaatggccttttccaaatggcctggcctcatccctgtgtgtcctgtgtctcttccctacatcacctccactttgtcaaatttcccctcacaggctggtggctgaactgaaccccgagcgccggggaagagttgtccgggagagatgagcgcacagccgccaacttgctggcatcagctctgcagcgtctgcggcagcctcggggcatcagctctgcggcaggcactccacgtcccgaaaggctcaactccttctcaccaccgcactgactaagcaggttttcttcagccttaacata

SEQ ID NO: 205943 - DNA, 601 bp, Human
ggtctaaaaaagataccaagtccagctaaatcttaaacactgacagcagttaaaagcctcatcttcagacccaggagaagatgacaatcaaaataaactgtgttcaagagacacagggccagaaattaaaactattcaacccctctaggcccagggactatcagagtatcacagaagaggtggacacatagattggaagagctaatattgacagataaaattagcttagtttctctataaattaaacactaatatcaaaggtacactgatgcaagaccagcatctgtgtccctatgccagwttaacaaggttttcttgggacattaacccattctttaattaaaaaattataaaaggttataaaatgatttatggaaattatatattttggtcaagatgattaaaatttaatagatttgtttataaaatttgagagagatttaattggcctcatactgtctttattagagtttattgtttagaaaagtaagtctcttctctcaaagaataaaggttgtgaaatctttgagttatcgctttggctaaatgaatgactgattttacaatgacctctgtgtgatcctgttctgtcattggttat

SEQ ID NO: 205944 - DNA, 601 bp, Human
gtagttttatatttatgtttgctaaatattataaggtgtcaatatttggaatgagggttataaagccataaatgcagcccaaaagagaattatctttgtgtaacttttggtaagtaaggcatttaatattgttggtttaatagcaaacagttaatactgaattatttggcaaaaagaaaaaacaaatacatttatttaaccttaagttttttacataggtaaacacctgaaattcgcaggctataaaattggttagcagggaaataactttaaatgatgaccatcagtttttataagtaakctattaaaaaattaattagataaatataatagaataaatgcttgttaaaaaacgacatataatttagaatctaaagtaacattaaacaaaataatagatattgcttaaatgtctgggtcatttccaatttaaaaaaaaatataggaaaatgtttttctgaaaaacaatgttttcttattaaaaagaaataatttttgtctaattcaaagattacttaaaggtcgtttctaaaacaaggtaaaaggaaacagtaaataaaagagatgcaaaaaaagttataaatattaagtggtatttttg

SEQ ID NO: 205945 - DNA, 601 bp, Human
tctactaaaaatacaaaaaaaattagctgggcgtggcggcgggcacctgtagtcccagctgctggggaggctgaggcaggagaatggtgtgaacctgggaggcggagcttgcagtgagccaagatcgcgctactgcactccagcctgggcgacagagcaagattccatctcaaaaaaaaaaaaaagaataataatttgggtatttctgctgtaagaaaattttactattgacatgttgtattaacaataagatttttcaggttttctatttactcttgagtcagttttggtatcatgtttkgttgtagttattgaatatatgtgtttatgggcaattcttggcatgatgttactcataatgctcccttactattttcggaaatctctgaagtatctgtaattgtgccattgtattttctactacaagttaatctgtgttttctttatttttgacctatctttccagagatcgtttatgtaattaggcaggccaactaccaacatctggctttgtcgatcctctctgttgggtcttttttgtgtattttgttacatttcttaattcttattgctttcttccttttactttttggaggtttat

SEQ ID NO: 205946 - DNA, 601 bp, Human
gccgtattcaatagctccaaatcagtctccacaacagttctgcagtctgcgagctcctcttccatatcctggtcaacgtttagtatgaagagactgttgtaaacaacctatagtgttttactgggatttcaatttacatttctgattactaaggagggtgagtaactttgtatttattaagcatatctgtttcctccttgataaagaattttttgttcatttttctgttagattgcttatcttgtcatattggattgcaacaattctgtaaacattagaagccctaattggaatatgtggrgtctgtttctggctctctcttctaatgtgctctacccatctgtgcccgcgctggtgctacatgagttcagtcgtggttactttacacacacacgttgatatttaaggaggcaacttcctcactatattttttttcacaattatcttggctattcttggcccatataaatattatgccaggatatttattagaattgtgctgaggtctaatatcgagtcttctttatgaacatatcatcctacttaggacttctttaatgacttccaaaaaattatagaattttctccatataaatctgaa

SEQ ID NO: 205947 - DNA, 601 bp, Human
ctacttaataggtcttatgtgcctcataagatgtaaaacttcatgagatacatgtgggaagggcagcttgtatattggtaattggtaagtggtgcagagttaaaacaaagcgaacaatgcattgaacaagactggtaagaaatacagcaatatattagcaatatttgcatttgagtggtgggattacaggaattttctggcccagcgttgactctattttccaaatgtacatctttaataataaggaatacatcttcaaagcctacatgactagtgtaaccactttacctcctcaccagcrttgtgacagaattttcagttatcaaaaaaattctatttattttggttctagttcaatgcctaccattaattagccagatacactggcccaagtcaaatgagacgacataggtgaagtgcaaaagccaagaattgtgcattccgtgctgtggccccagagcagcctgtgtcccctgatgccacttgataactgcccactcatcccctccctgctagacattgcaggtgggtgctgagcctccttggctgtcaccagcgccaggcacagagagcaggcctactgaccaaatgacttaggtgc

SEQ ID NO: 205948 - DNA, 601 bp, Human
acaacctggcattttcaaagtatgcctcattcaacacttgtttcaaataaaaacgagagaggaccaatgcatttgagactaggctgctgagatgactggccccacctgggagcttttgctgttccctgactcctccctcactctcccactgccaccaccagtgcagccccaggcacacagcagcccagggcagaagggccttttccttccagaggaatgaggggccgaagctcctttctcctccccaggagcaaagtccagggtccaggtttccccctcctaacctgagacctctgactgrggggttcagcagagctgcccgccacctggcaggacccccctaatttgtcagttaggacccagttagaaggtgcccaccagtgcgtgctgatcatgagagtgggggaggagatgtgtgacagctgtggcgtaccccccagcactccactagcatttgagattacagtggaatctcccacttacccggtagtcagtgataagccctggagaaaagagaaagaaaaagaaaaaagaaatcgttagacaggtttgttgatcacacgctaatccttttcattttccaggtaaatttcttgtgtct

SEQ ID NO: 205949 - DNA, 601 bp, Human
ccttgggttctattcttttgataagcttcgcagtactgcctttggtcccaaattcctttccagactaacactagaacaacctggcattttcaaagtatgcctcattcaacacttgtttcaaataaaaacgagagaggaccaatgcatttgagactaggctgctgagatgactggccccacctgggagcttttgctgttccctgactcctccctcactctcccactgccaccaccagtgcagccccaggcacacagcagcccagggcagaagggccttttccttccagaggaatgaggggcmgaagctcctttctcctccccaggagcaaagtccagggtccaggtttccccctcctaacctgagacctctgactggggggttcagcagagctgcccgccacctggcaggacccccctaatttgtcagttaggacccagttagaaggtgcccaccagtgcgtgctgatcatgagagtgggggaggagatgtgtgacagctgtggcgtaccccccagcactccactagcatttgagattacagtggaatctcccacttacccggtagtcagtgataagccctggagaaaagagaaagaaaaag

SEQ ID NO: 205950 - DNA, 601 bp, Human
tgggattacaggagtgagccacagcacccggccacaggtcatctcttgatggcagaagacagccagctcagtggccacacctctgttccccctgagtttcaccctcccccttgggttctattcttttgataagcttcgcagtactgcctttggtcccaaattcctttccagactaacactagaacaacctggcattttcaaagtatgcctcattcaacacttgtttcaaataaaaacgagagaggaccaatgcatttgagactaggctgctgagatgactggccccacctgggagcttttkctgttccctgactcctccctcactctcccactgccaccaccagtgcagccccaggcacacagcagcccagggcagaagggccttttccttccagaggaatgaggggccgaagctcctttctcctccccaggagcaaagtccagggtccaggtttccccctcctaacctgagacctctgactggggggttcagcagagctgcccgccacctggcaggacccccctaatttgtcagttaggacccagttagaaggtgcccaccagtgcgtgctgatcatgagagtgggggaggagatgtgtg

SEQ ID NO: 205951 - DNA, 601 bp, Human
tcaatacggagtttttagcaaagcctatgttattttatgtgaaccagagatggtgttgtgcctttttttctaatgatatctaagctgggaaagagcaaaattaaaaaataataaaataaaaggcatgaagtgttcgtgcctgttaccccattttcagtctcatgctgcaggaagcagctcatcctcagcagaaagctggatgtgccagatgcccactgcatagtcatttaggaaagcaagggactttcccagggaagtagttaaataacagggaaataattataccatataacatgggatwctgtgtagattttctgtacttactaaggctgtggaggagtggagaaggtattgcaattttagtttcagtgccatgagaaccagctgcaatgtcgtttgtacagcacatggccctcatgcaacatgaagtctgagaaaggccatgaaccagaggaggagacagaaacacaggccacagcggcgcgaggatgcaaggtcagggtgagctggtcctcaggttatttttaatattattgtcatattttcccttcaataataactttccaaaagataagtcagattgacaatgggattatatgaa

SEQ ID NO: 205952 - DNA, 601 bp, Human
aagctagtagagataactagtagagataactagttgaagtaacagaaggacaaacgcttttcaaagaatgcttggcctatcaaggcagggtgaatggtgggctcaagtcttctggattagcagtgcggaaagggcctgaggtgctgaggagagtgaggctcagcactaaagacagaaggggacagaaagaccccatgagggtcagggactggtggtggagggagtaggatgaagaacctagggttgggaagaaggagtgagccctgaggactggaaggccctggatggagcagaagaacargctggggaagcctcaggcaagccctgccaccttcgtggtcctgcaggcgggtgccagtacagatctgtgattcttggtgaacggtagaaactgtctgaggagatcatgttccctgagctgctagatgcgggcagagctgggctggtttttgtcttgggcaatgtaacataagccagcattgctagggattgtgccccaggcctttgaaagacagtgccaagtttatctaaaaggactttggttcccagaggacttgttagtcaatacggagtttttagcaaagcctatgttattttatgt

SEQ ID NO: 205953 - DNA, 601 bp, Human
ccagcactttgggaggccaaggcaggtggatcacctgaggtcgggagtttgagaccagcctgaccaacatgatgaaaccctctctctactaaaaatacaaaaattagcctggtatggtggcacatgcctgtaatcccatctacttgggaagctgaggcaggacccaggaggcggaggttgcagtgagccaagatggcgctattgcactcaagcctgggcaatagagtaagactccatctcaaaataaataaataaataaaataaagtgtgggtggaatgaacaggtggcaactgcttctgracacaagagaagtagctcaagggcccagagccatggttctgcaggagcttctcaagtcaaaagggaaacagggacccaacctctgactcaggcattcagtgtggttccccccagttgcacaccaggccctgcccggtgtgttgacacattatctcctttgagcttcctagcagcactgtaaacaagggttcggatccccactttcttggagcaaaagcaggtatggagagtgacttgcccaatgtcaccaagccagcatgcagcagagcctgagccgaacctgcacacacagttgtctgc

SEQ ID NO: 205954 - DNA, 601 bp, Human
ctgttaaaaaaatagaatataaaagtcctagaagaaaactgtcaacaaaaacaagaatgaaaacaactgcttgacagcagatgagtctaataagcacgatgccaacactaaggttggttgactagacacatcctggacatggatggactgaggctcctcccacaaacatccagagcgtgtcttgccctctcggtcctctgtgcacctcccaggtctcatcactttgtgctcttccaagggctcaagtctcctctcctgctctgctacctgcaggctttcccacggctgcagctcctcctckcctcagagctccaagagtcaggtgaggcaaaaggacatagtaggtggagtggcagtgccacactctgactggcagccccttgacaatgacactgaccccagcctgctccttctcctgagtgctgtctttaatttgaacaaggaagcctcctggaaaggcttgaaatgattgtgaattaaaagctacctcagccgggcgcagtggctcacgcctgtaatcccagcactttgagaggctgaggcgggtggatcacgaggtcagaagttcgagaccagcctgaccaacatggtgaaaccccat

SEQ ID NO: 205955 - DNA, 601 bp, Human
tgttggtcaggctgttctcgaactcctgacctcaagtgatctggcctcctcggcctcccaaaatgctgggattacaggcgtgagccaccacgcccagcccaaatgttaactttaaatgaacaaagtgaattatatctcaatagaactgttaaaaaaatagaatataaaagtcctagaagaaaactgtcaacaaaaacaagaatgaaaacaactgcttgacagcagatgagtctaataagcacgatgccaacactaaggttggttgactagacacatcctggacatggatggactgaggctyctcccacaaacatccagagcgtgtcttgccctctcggtcctctgtgcacctcccaggtctcatcactttgtgctcttccaagggctcaagtctcctctcctgctctgctacctgcaggctttcccacggctgcagctcctcctcgcctcagagctccaagagtcaggtgaggcaaaaggacatagtaggtggagtggcagtgccacactctgactggcagccccttgacaatgacactgaccccagcctgctccttctcctgagtgctgtctttaatttgaacaaggaagcctcctggaa

SEQ ID NO: 205956 - DNA, 601 bp, Human
tttgtatttgtagtagagacgaggtttcaccatgttggtcaggctgttctcgaactcctgacctcaagtgatctggcctcctcggcctcccaaaatgctgggattacaggcgtgagccaccacgcccagcccaaatgttaactttaaatgaacaaagtgaattatatctcaatagaactgttaaaaaaatagaatataaaagtcctagaagaaaactgtcaacaaaaacaagaatgaaaacaactgcttgacagcagatgagtctaataagcacgatgccaacactaaggttggttgactrgacacatcctggacatggatggactgaggctcctcccacaaacatccagagcgtgtcttgccctctcggtcctctgtgcacctcccaggtctcatcactttgtgctcttccaagggctcaagtctcctctcctgctctgctacctgcaggctttcccacggctgcagctcctcctcgcctcagagctccaagagtcaggtgaggcaaaaggacatagtaggtggagtggcagtgccacactctgactggcagccccttgacaatgacactgaccccagcctgctccttctcctgagtgct

SEQ ID NO: 205957 - DNA, 601 bp, Human
cctttttttttgagacagagtcttgctctgtcgcccaggctggagcgcagtagcacaatctcagctcactgcaacctccgcctcccaggttcaagtgattctcctgcctcagcctcccgagtagctgggattacaagcatgtgccaccactcctgactaatttttgtatttgtagtagagacgaggtttcaccatgttggtcaggctgttctcgaactcctgacctcaagtgatctggcctcctcggcctcccaaaatgctgggattacaggcgtgagccaccacgcccagcccaaatgtwaactttaaatgaacaaagtgaattatatctcaatagaactgttaaaaaaatagaatataaaagtcctagaagaaaactgtcaacaaaaacaagaatgaaaacaactgcttgacagcagatgagtctaataagcacgatgccaacactaaggttggttgactagacacatcctggacatggatggactgaggctcctcccacaaacatccagagcgtgtcttgccctctcggtcctctgtgcacctcccaggtctcatcactttgtgctcttccaagggctcaagtctcctctcctgctct

SEQ ID NO: 205958 - DNA, 601 bp, Human
tcttttagggggatgaaaatgttctagaattagattgtggtgatggctgcacaattctgtagatatactaaaaatactcaaacgtagcctttttttttgagacagagtcttgctctgtcgcccaggctggagcgcagtagcacaatctcagctcactgcaacctccgcctcccaggttcaagtgattctcctgcctcagcctcccgagtagctgggattacaagcatgtgccaccactcctgactaatttttgtatttgtagtagagacgaggtttcaccatgttggtcaggctgttctcraactcctgacctcaagtgatctggcctcctcggcctcccaaaatgctgggattacaggcgtgagccaccacgcccagcccaaatgttaactttaaatgaacaaagtgaattatatctcaatagaactgttaaaaaaatagaatataaaagtcctagaagaaaactgtcaacaaaaacaagaatgaaaacaactgcttgacagcagatgagtctaataagcacgatgccaacactaaggttggttgactagacacatcctggacatggatggactgaggctcctcccacaaacatccagag

SEQ ID NO: 205959 - DNA, 601 bp, Human
tggcatctacaaattatgcaaataaaataaaagccataaccttgacgacattatgctaagtgaagaaaacagtcataaaaggcaatatgttgtatgttttcatttatacaaatgtccagaatagacaaacctacagagacagaaaacagattagtagccctgaggatggggaaagtggcatgactgggtgtggggtttcttttagggggatgaaaatgttctagaattagattgtggtgatggctgcacaattctgtagatatactaaaaatactcaaacgtagcctttttttttgagacrgagtcttgctctgtcgcccaggctggagcgcagtagcacaatctcagctcactgcaacctccgcctcccaggttcaagtgattctcctgcctcagcctcccgagtagctgggattacaagcatgtgccaccactcctgactaatttttgtatttgtagtagagacgaggtttcaccatgttggtcaggctgttctcgaactcctgacctcaagtgatctggcctcctcggcctcccaaaatgctgggattacaggcgtgagccaccacgcccagcccaaatgttaactttaaatgaacaa

SEQ ID NO: 205960 - DNA, 601 bp, Human
ggacagaaaccagtacacagatgggtttggtggcatctacaaattatgcaaataaaataaaagccataaccttgacgacattatgctaagtgaagaaaacagtcataaaaggcaatatgttgtatgttttcatttatacaaatgtccagaatagacaaacctacagagacagaaaacagattagtagccctgaggatggggaaagtggcatgactgggtgtggggtttcttttagggggatgaaaatgttctagaattagattgtggtgatggctgcacaattctgtagatatactaaaamtactcaaacgtagcctttttttttgagacagagtcttgctctgtcgcccaggctggagcgcagtagcacaatctcagctcactgcaacctccgcctcccaggttcaagtgattctcctgcctcagcctcccgagtagctgggattacaagcatgtgccaccactcctgactaatttttgtatttgtagtagagacgaggtttcaccatgttggtcaggctgttctcgaactcctgacctcaagtgatctggcctcctcggcctcccaaaatgctgggattacaggcgtgagccaccacgc

SEQ ID NO: 205961 - DNA, 601 bp, Human
cagatatggaggcagaaaagtgagccacagtgtttgactaacgcgcttcctccagaaactggatttgcagactggaggcacaagcaaagttttacaaaaggaaacatttgtcagctgaaaaatgccttggacttccttcatgagaggactcactatatggcatgagagaagaatggacagaaaccagtacacagatgggtttggtggcatctacaaattatgcaaataaaataaaagccataaccttgacgacattatgctaagtgaagaaaacagtcataaaaggcaatatgttgtatgwtttcatttatacaaatgtccagaatagacaaacctacagagacagaaaacagattagtagccctgaggatggggaaagtggcatgactgggtgtggggtttcttttagggggatgaaaatgttctagaattagattgtggtgatggctgcacaattctgtagatatactaaaaatactcaaacgtagcctttttttttgagacagagtcttgctctgtcgcccaggctggagcgcagtagcacaatctcagctcactgcaacctccgcctcccaggttcaagtgattctcctgcctcagc

SEQ ID NO: 205962 - DNA, 601 bp, Human
tagaccaggagagagtgaggccaagatggcagatatggaggcagaaaagtgagccacagtgtttgactaacgcgcttcctccagaaactggatttgcagactggaggcacaagcaaagttttacaaaaggaaacatttgtcagctgaaaaatgccttggacttccttcatgagaggactcactatatggcatgagagaagaatggacagaaaccagtacacagatgggtttggtggcatctacaaattatgcaaataaaataaaagccataaccttgacgacattatgctaagtgaagaaracagtcataaaaggcaatatgttgtatgttttcatttatacaaatgtccagaatagacaaacctacagagacagaaaacagattagtagccctgaggatggggaaagtggcatgactgggtgtggggtttcttttagggggatgaaaatgttctagaattagattgtggtgatggctgcacaattctgtagatatactaaaaatactcaaacgtagcctttttttttgagacagagtcttgctctgtcgcccaggctggagcgcagtagcacaatctcagctcactgcaacctccgcctc

SEQ ID NO: 205963 - DNA, 601 bp, Human
ggcccaccagcctggggtaggcgcagaggccccacccctcccactacactagagatggaagcctggtatcaataagccaatgggaagcccttgctgtcctgcctgggccctgcttccatagcagccggtcttctgacacttcacctccatctccctttgctcctctgtccttcttctgtttgcaggcagtgactccatgtcttctaagccatggagtcttaaatagaaggaactgaatgtgggacactgcatcctagtcacccaaacctcacaggactgcacttcgtggccctgtcttcaragtggagaagcagggaggatgagtgggaaggagagagttctatccactgcatggaaccacctcagacgagcacctgctggatgttggcacctggccatagagctgtgcaaatcccctggcctctagctatgggcctgagtgccctgctcctgttgtgcccaggtagacagtgatgggccagaggaaatttggaaaccgtgggtgaacaccaaggctgggtgaatctggatgaggactcaaggatgaggatagagaaaaaaagaaattatcataccaagggaatggaattttaccaaaaag

SEQ ID NO: 205964 - DNA, 601 bp, Human
gccaggcgcggtggctcatgcctgtaatcccaacactttgggaggccgaggcgggcagatcacgaggtcaggagatcgagaccatcctacctaacatagtgaaaccctgtctctactaaaaaataccaaaaaaaattagccgggcgtggtggcgggcacctgtagtcccagctactcgggaggctgaggcaggagaatggcacgaacccaggtggcagagattgcagtgagccgagatctcaccactgcactccagcctggatgacagagcgagactccatctcaaaaaaaaaagagaaaytgtttctttcttgaaagtttaatatcactcatctgcaaaccacttgagtatttttgaaggtatagtattgattacaatttcttccagagctgtttctctattacgattttatatttcttcaagagtctattttgtttttacatttttgcaataaatcatctatcttcccccagatttccattttttcgttcacagttttcttgatgctgtttttaaaacttgctaacgtgctcttaccatgattttcttgggcaccttttgccctcctgagtgtctgtgctacaggtttgctgttatggt

SEQ ID NO: 205965 - DNA, 601 bp, Human
agaagttacaaattattctcccaggctgaagtgcgcctttcagcatgttaaatatcatctgtaacgtctacatagaaatttgtaatggtaatacagtcaaatttaccattttccctttatggttgtgctaagtcttattcacaaaagtctttcttagcctaagagaataaagattctcactattcattaattcttgtcattcaaacaaataaaaggcattttgttctttcacttttaattatttaattggcctgaaaccaattattgtgtagaatacgcagcagggttccattccttgccmccccatgtgaacagtcatggttcctgtaatctctgttctgccgtgatttcactgtgctgtatgtttccataaatgtgtgggtctccttatgggatatctattctggtcctttggtctatttgtctggccttgaactaacaacatcctttcttagttgtgataccacataagagggattgctatctgatagtgcaaatcaatcctccaaacgccttgttgtttttcaaatttgtcttcaaattcttgagtttcactctttcttattaaagttaggaaacatttttcaagtcacatgtgaca

SEQ ID NO: 205966 - DNA, 601 bp, Human
cccatgttatagacaaggaaactgaggctcagtacacaagacagcagagtttcaaatgaaaccagcactcactggcagcctctcaggctgttaccactgcaccacacggcccactaagctcatgagcctttgggagctctctacagagtcaactctatctgcttttgtacacagacttcaacatctctttttcaaccctttgggcatctttactcaattgggttcctggtgagaggcatggccaggaatctctgcttgggttatgagcagtaacaacaatcagacaaaatttgcctaaaaytgagaggccaaacttctaaaaataaaacttcacatctcaaaaatattgttaaggaaaaaactaaatatagcattaccctacaatccagcaattccacttctagatacataccccaaggatttgaaagcaggaactcagacccttgtatgtcaatgttcacagcagcactattcccaacagccacaaggtggaggcaacccaagtgtccctccctcaacagatgatggaaaaataaaatgtggtccatccacacaatggaatattatttggccttcaaaaggaaggaaattctggcacatg

SEQ ID NO: 205967 - DNA, 601 bp, Human
ttcactcagtaaatctgagcatcttctcaaattactagatatttaacatattttaagacagaataatagtctatcatcagtgtatgtaatgtttatctgatcagtcttgtctttccctatttcctttattctaggggaatatgctattgattgaattgaaatggatatacatgcacacacatgcacacgtcattgaaataaattcctggaattgatgggtttaaatgtatgacctttgcaaggcttttgttagacagtagcaaaccgccttccagaattagacccacttcttcgcactcamcagcaagagttacttcttaaagagggcacaccatggcagacatgatatcctgtgctttacagacgcctctttccagttctcacaacaacttcacaaagaaggcactgttgtcccatgttatagacaaggaaactgaggctcagtacacaagacagcagagtttcaaatgaaaccagcactcactggcagcctctcaggctgttaccactgcaccacacggcccactaagctcatgagcctttgggagctctctacagagtcaactctatctgcttttgtacacagacttcaacatctctt

SEQ ID NO: 205968 - DNA, 601 bp, Human
ctcccccaagcactgaactcaggggtctcagagcacctgttagtaggaaaattctgcagtttggtgagtacactgtaatggcacaatcattcatttcaaatatttaatttatattactttttttccattgtaagaataactacattataggtacattgagaaactgcaaataagccaataacaaaaacacatttctcaccccaagaggaatgccatgatagcagatagactgtcaatctctaaaaacttgacaatgaatgtcttccttccctctctcagctcctaacctctctgctattargaagcccccagatcctgagagctttaggctctctccctccccgtgcctgggacacaactctgcatcctcccagggtatgatccactggatgtgtcccccaccacctgctcagaccatgacttctccccactgcctacacactgcctcgtcctcaaagatctacaaatattcttgggaaataaatcaagaaaaatactcagagtgaaataagtcaacttcctcaaatttcaaactcatcatctattcattttccaactagtggtgccacaaattgctccagactgatgtatcaacatcaaa

SEQ ID NO: 205969 - DNA, 601 bp, Human
gggaaaaatacaatatataaaataatgctcgcaacaggcagcttatacatataggtgtgtgcagggtggctcctctaaattaaaacctgagatggactttggctttgattcccatcccaccactgagttaacacctgtctgtgacttctgggcaagttatcaaacctctcagcctcagttttcccatctgtagctctgatgaggaagataagacatgcagggaggttctagcacaggcctcaaagtcatcatcagcatcattatttttgccaataattatgcatgatgggtacatgcaaaygaagaatctaaagtgcaaagtgattcctaacttacccccagtcaaagagcattgctggaagagactaaaagacagaaaaacagccagcccaaagccaggctatgtccctcggcacctaatgttgctaagaatggcttcttggaggaaaaaaaacaaaattttttcttgatctattttaccttctctaataattggcattcttttctaattttggtcttttcctcttgacagtctctccactaagaaattggtgcttctgaaatagtccattctccaatcttttttctacacttcccctgt

SEQ ID NO: 205970 - DNA, 601 bp, Human
ggggtccctggagtagtcaaattcctagagatagtggaatggtggtggccaggggctagggaaggaaatggggtgttatttatttgatgggtacagagtttcatttttgccagatgaatagagttctatggatggatggtggtgaaggttgtgcaaccatgtgaacgttcttaatgccattgaaatgtgcatttaaaaatggtaaggatgggctgggagcagtggctcacgcctgtaatcccagcactttgggaggccgtggcgggtggatcacctgaggtcaggagttcgagaccagccygatcaacatggcgaaaccctgtctctattaaaaatacaaaaattagccaggtgtggtggtgtgcacctgtaatcccagctattcaagagcctgaggcaggagaatcgcttgaacccgggaggtggacattgcagtgagctgagatcatgccactgcattccagcctgggtgacagagcgagactccatctcaaaaaaaataaataaaaaacaaaaaataaaaaataatggtaagggtggtaaattgtgttaggtatattttaccacaattaaaaataataattaaaaaacaaacgcagtt

SEQ ID NO: 205971 - DNA, 601 bp, Human
tctttcaggcctttagtatttccagttaagtatttgacaagttaaaaaccaatatatatactactttgtttctgtactttttggcttgtcactttatagcagtggtttgaaaagttttaaatcagaaatgagtatttacactttggaaaatatatttgaatcagagaggaaaggtggcctaaggaatgagatttcatgacagaaaatggtttttattaattagtaactgtcagcatatattttctggtccaattcaaaggggagggaaacataaatctgttaaatctcaacgctcacactraaatgttgcaatggggaaatttgggcttattcatattcaataattaaatatcttcaaagcttagaagaaatacaaatttgtttttctttctttgttctatttttaaaaagtaaaagcaggtatataccccccaaaattgaaagtagggacttcaacagataatcgtacacccttgttcacaacagcactattcacaacccaaaggcggaaacagcacaagtgcccctcaacagatgaacagatgaagaaaatgtggcacatatacacacaatggaatattattcagccacaaaaaaggaa

SEQ ID NO: 205972 - DNA, 601 bp, Human
ctgaagggcataagggaatccagagactcttgagaagggatcgtagctcacctcagaacgcctggagcagttggctaaacacagcaattttaggagcccctgacccctttgtccagagtgtggtgagtcactccagtgaggaagagagtttggcaggtggcagcctgccttggcatctgtttgggtagattgctaggctctgctcattttggcctacacctctgctgatgttttccccaggctctgggatttaggtgggaaaagtcattaacgtgccctcaggcagggtcagagccatgakatctgctatttggtgtttttgggtaagtgtgtgaaaaggattggtaaccgtatttgaaaatcaatgatcatgtcggctcaacatcacccgaacaaagggatgaccctcatttttgctttttatctttcaggcctttagtatttccagttaagtatttgacaagttaaaaaccaatatatatactactttgtttctgtactttttggcttgtcactttatagcagtggtttgaaaagttttaaatcagaaatgagtatttacactttggaaaatatatttgaatcagagaggaaaggtggc

SEQ ID NO: 205973 - DNA, 601 bp, Human
gagtttaatttcaccagccagggctgccaacctaatagaatttctgactctgggtgtgtcagtgctgagcagaggagtctctgagccccgggttgatgaatcctgagtgtgtcaggtgatccttagaagaaacagagcaggagatggtagggggctttgctttccttggctggaggcagccctgctacccactcaacccaatgtttctgttgccccccagcactggccaccttgggaaccaagatattgggaagggacctgaagggcataagggaatccagagactcttgagaagggatcrtagctcacctcagaacgcctggagcagttggctaaacacagcaattttaggagcccctgacccctttgtccagagtgtggtgagtcactccagtgaggaagagagtttggcaggtggcagcctgccttggcatctgtttgggtagattgctaggctctgctcattttggcctacacctctgctgatgttttccccaggctctgggatttaggtgggaaaagtcattaacgtgccctcaggcagggtcagagccatgagatctgctatttggtgtttttgggtaagtgtgtgaaaaggatt

SEQ ID NO: 205974 - DNA, 601 bp, Human
aggactaggttagttattatctgctttataacacagcttggcacacagtaaacaggaagatgttatttattagccctatttcatctatttcttacaaaataacaaaaagtgatcgttattaacctggcttaacagctgaggaaataggcctggaagaattaaatcacctgcccaaggtcacataagcggtattgaaaataagctttgcatccctcattctctcctaccaggtgtgtgctcctcacagaagcttcagaggggcactctgccctctggttaggaaggcctttgttttaaaggsctcccctcatctctcaaggctaaagggcataacaagacaagacataaggaaacaaaacaacaacaatgagggagggaagtcctgggcaaccacggtagtgcagagggggtatggagtgggcagggtcacccccgggggtagtgcttgggcttctggagtgggtgggacagtaggagcagggtttagccagatcacgctcaagatcctggtgaagacagacagatagaagggaggggtgaggacagaagggaggctgctgaaatggcagcgatgagatcactgaggcctggccagcacagc

SEQ ID NO: 205975 - DNA, 601 bp, Human
aaacccaaatgtacatcttggtgatcaggttccaaacctcaatcctatttttcaaatattatggaaggggtagaggggaaacaccaagacaagtatgactgtatggaagcatgcatattacatgtattcatcatgattgacattccagagacaattcaatcattagagctgggctgcatttctacctgtctccagggagaagccattcggagcatctgctcagctcccttcagcacccccttctctcctccccaccccctccggtaggccgcacacagccacagctgcatagcacgaccccactggcctggactcagctgactgaatcacaggtgtctcccaggatcaggactctcccttccctgggattccagaagtgaaacaagagacagaaacagagcagcacccaacactgacactggttccagcccagaaaggttaagtaggggctgacactgtggcaggggtttgtgtgtggctgctactacaacacatgcctgagggcttcgggtgcccacccatcctctcgattggccagagtgcagaaggaagcccatcttcacagaggaaggcatggggcagatgcagagagagaagccac

SEQ ID NO: 205976 - DNA, 601 bp, Human
gcacagtgccttgcacatagcaggcactcaataaaaggtactactggaattgaactggctacaaagttcaacccaagggcggcacactgcacacactcagtgtatccgttatcccatcaaagcaatgtatctgcctcttgactttgcaagaccaacactattccccccaacaccatttaactcacagagagcagtgtccctgccgacagctctcatccttggagaaggctctgcccatgaggcctggacctacctgacagcgaggatgtgcacaggctgggagcgctgcaccctctgcctyggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctctgcacagaaaaaggcaagagcaaaaaagaaactttaacaatggagagcaatcaaacccaaatgtacatcttggtgatcaggttccaaacctcaatcctatttttcaaatattatggaaggggta

SEQ ID NO: 205977 - DNA, 601 bp, Human
actccataaacatcagatggcgcagttgttctaatgatcacctccacccctaggggtcttcctccagaggctgcagcccatcctggctcacagccctgccaaccggtggggaggaactttcaacccctttctctgccagtttctctgctaagctgacttgttggctgtttgaccttggacacattactgaaatgctctgtgcctcagtttcctcatatggggacaatggttgtgtcctatctacttcatggatctactttaagtagaaactacaagttcaaaaaggaggttattgccctgygggtccaatggaaactcttctgctttcggcagatcatattcaaagtcaggactacaagacagaaactcttcaactcctgtgtactgacatccaggtgcccgggtgagcccagcattttcacacctattattgagccagtggtgaaactttttcaaagaactaagattcatctttaaacatcaaatcattgttattatttgccattttttatgagactttttctaaaatataaagataaaacagagttttgatcaataatgaaaagaggtttaattggttcatggttctgcagcctgtaca

SEQ ID NO: 205978 - DNA, 601 bp, Human
tgaggagtaaatgaacatataaataaacaaaaaataaacatatccaccacttacgacaaggcctggcacacagaaatccctcactccataaacatcagatggcgcagttgttctaatgatcacctccacccctaggggtcttcctccagaggctgcagcccatcctggctcacagccctgccaaccggtggggaggaactttcaacccctttctctgccagtttctctgctaagctgacttgttggctgtttgaccttggacacattactgaaatgctctgtgcctcagtttcctcatatrgggacaatggttgtgtcctatctacttcatggatctactttaagtagaaactacaagttcaaaaaggaggttattgccctgtgggtccaatggaaactcttctgctttcggcagatcatattcaaagtcaggactacaagacagaaactcttcaactcctgtgtactgacatccaggtgcccgggtgagcccagcattttcacacctattattgagccagtggtgaaactttttcaaagaactaagattcatctttaaacatcaaatcattgttattatttgccattttttatgagactt

SEQ ID NO: 205979 - DNA, 601 bp, Human
ggctccccctggccaaatgctgagcagctgcagggcgggtgccaccccacgtgggggtagcaacgagcctgggtgggaccagggaggtgagaccgaccctgcactgcttctgtagaagcacctgggcaggaccccagacccagaagaggaagcagagcctgggcagggtgaggaagttgaatccagggcaggtgaaggacagccaggcaggaaggaatgagtgggctgtcagacggtgacatcccagcacgtggatctccgatcagaagtagccccctttgcgccggtgtacgtctccccsacagctggaggatcacaggtttgaaactcagctattcccgccaacccagatgactcaggcaagccccatgggtacccttagcaaactcagcacagcactcaggaagaacctggccaatgcagggtcacgaagccagggtgcagtcatcgtggaagaacttggtaagcctgcctggggctgctgcatgctctgggatccccagggagaggacgcaaggcagctggggaagacctccctgtccttctagatagaataatggctgctctcttttggcacatgcctgccacgtcttagactacc

SEQ ID NO: 205980 - DNA, 601 bp, Human
tcagggaaagcccctggcatgccaggtgcagggagacaatgcagacaccataggagtcacctcgcaggatgccacagccgaaaccagcaggccaggacctgcctgccagggtgtctgcttcagcccacacagtgcttacagacactgaaatgtgcaaaatgtggagagttcaggtcttcagtggcaattctgatttctctcaaagcatccaattttctggtgacactggtcccatgctcctgctggccatgctcggctgatgggcggtggctgtggacacagggcccctcttccctagcgyggacaccgacgctcagtcttgcctcgaggagctacttctgccctgacttctgatgtcgctgagctgagaccctcctcacacagcaaacagccaggatcagaatgcaggaaccgagaaggcctttgggacagcccccctacagggtatcgtacccaccagcctgaacagtcaaatgtacctatacacatggctcccctcagcctctcagagccttctgaacttcacccagcacctgcaggaagaaaatggcaccccactcacctttctctcctctcccaggaccttaaagaagtacagcag

SEQ ID NO: 205981 - DNA, 601 bp, Human
aatgtaatcctttttagattcgggccatcatcccagcttgctgagcccttagtggacgccagatccagtgcccatcagggaaagcccctggcatgccaggtgcagggagacaatgcagacaccataggagtcacctcgcaggatgccacagccgaaaccagcaggccaggacctgcctgccagggtgtctgcttcagcccacacagtgcttacagacactgaaatgtgcaaaatgtggagagttcaggtcttcagtggcaattctgatttctctcaaagcatccaattttctggtgacackggtcccatgctcctgctggccatgctcggctgatgggcggtggctgtggacacagggcccctcttccctagcgtggacaccgacgctcagtcttgcctcgaggagctacttctgccctgacttctgatgtcgctgagctgagaccctcctcacacagcaaacagccaggatcagaatgcaggaaccgagaaggcctttgggacagcccccctacagggtatcgtacccaccagcctgaacagtcaaatgtacctatacacatggctcccctcagcctctcagagccttctgaacttcacc

SEQ ID NO: 205982 - DNA, 601 bp, Human
gcaatgggatctgctacatgtgtgggttttgcttgcacggtttcagggattcacgcgtcccctcataagtaattgaatgacaagttgagagttcacttaggcgtactgaaatgcatttctgtcgtctggggcactgctgtggcacactgagaagacagctagaagctcgggtcctgagtctaaacccactttttgtgatgtatttgtcaatgaccttggaagatgactttatcctccctgggcctcaggttccttaagagcacatgtctcgtggtcactcctgatgaaggcagtgatcacrtggcaaaggggtggggcacagtagtggtgccgcgttcatgcagtaaaggggcatgggggcacagctgcggtgccgtgttcacgtgggaagtagggggtgcagccatcatgccgcgtccacaggggaagtggcagggaggcgcaactgcggtgccgcattcaaatgggaagtgggggtgcagccatcatgccacaaccacagaagtggggggtgcagccgtggtgctgcattcatgcaggaagggaggtagggcacagccatggagccatgtccatgcaggaagtggggtggggtggacgt

SEQ ID NO: 205983 - DNA, 601 bp, Human
ctcacctgggaagagtgtctgccaggtgtttccacacacgtaagttattattttcccctggcccttcatgctggctcctgtgtctttatgccatgtccccttcattctttaagcatctcccaggcagccctggctccttttattggagaatggtatctagaaatgacctgagcgttaggttgaacgtatatttaaagacagaggaaacacagaactgcaagttgtcttacagaccatgaaaactatgagaaatcaataaatcacatcttaccaattttacttagatgcactcagctgtccmacttcactccactgccctagtccagataacacgtcagcatctcctgcacctgcatcccaaccggctatcccacacctcctccagcccagtccatccttcacactgcagcaggcaaagcaaagtacaaagctgctttcccctctctgccagagacctcctttgccctggagaccaatctcttcctgagacacctaaggccctggcttcctaggcgctgcctcctctatactatctcagccaccatccagggtgcctgtgccttcctcaactgtcctcattccctctttctggaacactgta

SEQ ID NO: 205984 - DNA, 601 bp, Human
ttctgaggaactggggctaggacttcaacttatgtattctgagggggacataattcaatccataacagtgtgcaataaggccctaattcagctgctcatccaaatagtttatagttgtcggagcacattaaattaaacaatgatgccacttttacaagattctaaccttgtatgtatttgactctcttgagtacatgcttcagtgcacagaactttcactctccattcttcaactcaaaccatgtggttttcatgacagtagctttataacatcaaagccactcttttgaagaaggtaatytgtcagcattgaaagaccaaatccaaatggtctcttctgtgtttccatccaacccaacctcttggcagggctggaccctgctgacgaccctcactggacgcccagccacacaggtcccactcagtctgttctaacctcttcatctcaggcttccatgtactgtccccacttggaagggccctgatctattctggaaattgtaggtagaattttggatttcaaattttcaaaaacctagatgtaaataatgtgtatttctagttccaaatcagggttctgactgattcagtggctgagaca

SEQ ID NO: 205985 - DNA, 601 bp, Human
aaatgtctatcaatggtagactggatttaaagagtggtaatatacaccacagaatagtatgtagtcataaaaaagaatgaaatcatgtcttctgcagcaacatgggtggagctggaggccattatcttaagtgaattaactcagaaacaaagaagcaaatactacatattatcacttagaagttggaggtaaacaatgcatacacataaacataaagatggaattaacagacattggggactccaaaatggagaaagatggaaggagggggtgagggttttagaaattacctgttgggtamaatcttcactatttgggtgatgggtacagtagaaactcaaacctcattattatgcaatatatccatgtagcaaacctgcacatacacccccgagtctaaaatttaaaaatacgttttaaaattctgctttataattgatagatttcaagtttgcagtgaaaattaaaaagatgttgtttttaaaaatccttttttctaaaggagataaagttctagaaataactaaagagttcttgaaagtcaagcatggtttgccaggcgcagtggctcacgcctgtaatcccagcaccttgggaggcc

SEQ ID NO: 205986 - DNA, 601 bp, Human
taaaaagacatgcatctgtatgtttatcaaagcactattcacaatggcaaagacatagaatcaacctaaatgtctatcaatggtagactggatttaaagagtggtaatatacaccacagaatagtatgtagtcataaaaaagaatgaaatcatgtcttctgcagcaacatgggtggagctggaggccattatcttaagtgaattaactcagaaacaaagaagcaaatactacatattatcacttagaagttggaggtaaacaatgcatacacataaacataaagatggaattaacagacaytggggactccaaaatggagaaagatggaaggagggggtgagggttttagaaattacctgttgggtacaatcttcactatttgggtgatgggtacagtagaaactcaaacctcattattatgcaatatatccatgtagcaaacctgcacatacacccccgagtctaaaatttaaaaatacgttttaaaattctgctttataattgatagatttcaagtttgcagtgaaaattaaaaagatgttgtttttaaaaatccttttttctaaaggagataaagttctagaaataactaaagagttc

SEQ ID NO: 205987 - DNA, 601 bp, Human
aacaaaagatgttgacataagtgtggagaaaaggaaagccaaatacactgttggtgggaatgtaaattaatacaacctgtatggaaaacagtatggagatttcccaaagaaataaaaatagaattaccattcaacccagtaatcccactactgggcatgtatgcaaaggaaaagacatcattatattaaaaagacatgcatctgtatgtttatcaaagcactattcacaatggcaaagacatagaatcaacctaaatgtctatcaatggtagactggatttaaagagtggtaatatacaccacagaatagtatgtagtcataaaaaagaatgaaatcatgtcttctgcagcaacatgggtggagctggaggccattatcttaagtgaattaactcagaaacaaagaagcaaatactacatattatcacttagaagttggaggtaaacaatgcatacacataaacataaagatggaattaacagacattggggactccaaaatggagaaagatggaaggagggggtgagggttttagaaattacctgttgggtacaatcttcactatttgggtgatgggtacagtagaaactcaaacctcat

SEQ ID NO: 205988 - DNA, 601 bp, Human
tcactatactgtccaggctggtctcgaactcctggactcacccacctcagcctcccaaagggctgggattacaggtgtgagacactgccttaatcttatatttagaaaaccctaaagacacttccaaaagactcctagacttgataaacgacttcagtaaagtttcagaatacaaaatcagcatataaaaatcattagcatttctatacaacaataatattcaagctgagaacaaaatcaagaactcagtcatgtttaaaatggccacacacacacacacaacatacatacacataatacktaacaatacatctaaccaaggaggtgaaagattgccacaaggaaaactacaaaccctcatgaaaggaatcatagatggcacaaacaaatggaaacacatctcatgctcatggattggaagaatcagtatcattaaaatgactatactgcccccaaagcagtctacagattcaacataatttctatcaaatttccaatgtcattcttcacataattaggaaaaaagattgtaaagttcatgtggaacaaaaaaaaaagagcttgaatagccacagcaattctaagcaaaaagaacaaagcc

SEQ ID NO: 205989 - DNA, 601 bp, Human
ggcatgtgccatcacacccatctaattttttttgtactttagagatgaggtctcactatactgtccaggctggtctcgaactcctggactcacccacctcagcctcccaaagggctgggattacaggtgtgagacactgccttaatcttatatttagaaaaccctaaagacacttccaaaagactcctagacttgataaacgacttcagtaaagtttcagaatacaaaatcagcatataaaaatcattagcatttctatacaacaataatattcaagctgagaacaaaatcaagaactcartcatgtttaaaatggccacacacacacacacaacatacatacacataatacttaacaatacatctaaccaaggaggtgaaagattgccacaaggaaaactacaaaccctcatgaaaggaatcatagatggcacaaacaaatggaaacacatctcatgctcatggattggaagaatcagtatcattaaaatgactatactgcccccaaagcagtctacagattcaacataatttctatcaaatttccaatgtcattcttcacataattaggaaaaaagattgtaaagttcatgtggaacaa

SEQ ID NO: 205990 - DNA, 601 bp, Human
tggtagggtctggctctgtcactttgctggaatgcagtggcgtgatctcagctcactgcaacctccatctcctggcctcaagtgatcctcccaccttaccttccccaagtagctgggactacaggcatgtgccatcacacccatctaattttttttgtactttagagatgaggtctcactatactgtccaggctggtctcgaactcctggactcacccacctcagcctcccaaagggctgggattacaggtgtgagacactgccttaatcttatatttagaaaaccctaaagacacttccraaagactcctagacttgataaacgacttcagtaaagtttcagaatacaaaatcagcatataaaaatcattagcatttctatacaacaataatattcaagctgagaacaaaatcaagaactcagtcatgtttaaaatggccacacacacacacacaacatacatacacataatacttaacaatacatctaaccaaggaggtgaaagattgccacaaggaaaactacaaaccctcatgaaaggaatcatagatggcacaaacaaatggaaacacatctcatgctcatggattggaagaatca

SEQ ID NO: 205991 - DNA, 601 bp, Human
tcaccactactattaaaacgtagcactggaagccctaaccagagcaatcatgcaagagaaagaaataaaaggtatccacattgaagaagagaaagtcaaattttctgtgttcatttgatggcatgagttgtgttttttttgttttgtttttgttttttggtagggtctggctctgtcactttgctggaatgcagtggcgtgatctcagctcactgcaacctccatctcctggcctcaagtgatcctcccaccttaccttccccaagtagctgggactacaggcatgtgccatcacacccakctaattttttttgtactttagagatgaggtctcactatactgtccaggctggtctcgaactcctggactcacccacctcagcctcccaaagggctgggattacaggtgtgagacactgccttaatcttatatttagaaaaccctaaagacacttccaaaagactcctagacttgataaacgacttcagtaaagtttcagaatacaaaatcagcatataaaaatcattagcatttctatacaacaataatattcaagctgagaacaaaatcaagaactcagtcatgtttaaaatggccaca

SEQ ID NO: 205992 - DNA, 601 bp, Human
tctgccaaactaagcttcaaaaatgaaggagaaataaagccttccccagataagccaatgctgagggaatttgccactactagacaaatcctacaaaaaaattctcaaaggagttataaaaatggaaacaaaaggatgatactcaccatcataacagcatacataagtagacaaagctcactgtataaagcaattacacaactgagactataaataaaccagctaacaacactatgacaggaataacacttcaaataccaatattaatgttgaacataaatggcctaaatgttccatttaraagacatggactggcaaactggataaaaaaacaagacccagccatctgctgcctacaagagacccacctgacggctaaagacacctacagactcaaagtaaatgggtggaaaaatatatatcatgcaatggaaaacaaatgtgagcaggagtagccattcttatatcagataaaacagactttaagctaacaacagttttaaaaaaagagacaatgaagggcattatatcataagaatgcactcaatacaagaggacataaattttggaaatacgtgtgcaagcaccaaagcacccacat

SEQ ID NO: 205993 - DNA, 601 bp, Human
ctcagcagaaaccttacaagtcagaagagactgggggtctatttttagcctcctttaagaaaaaagaaatgtaagtcaagaattttatattctgccaaactaagcttcaaaaatgaaggagaaataaagccttccccagataagccaatgctgagggaatttgccactactagacaaatcctacaaaaaaattctcaaaggagttataaaaatggaaacaaaaggatgatactcaccatcataacagcatacataagtagacaaagctcactgtataaagcaattacacaactgagactayaaataaaccagctaacaacactatgacaggaataacacttcaaataccaatattaatgttgaacataaatggcctaaatgttccatttagaagacatggactggcaaactggataaaaaaacaagacccagccatctgctgcctacaagagacccacctgacggctaaagacacctacagactcaaagtaaatgggtggaaaaatatatatcatgcaatggaaaacaaatgtgagcaggagtagccattcttatatcagataaaacagactttaagctaacaacagttttaaaaaaagag

SEQ ID NO: 205994 - DNA, 601 bp, Human
caagaaattcagagaacccattagagatactatagaagatgcacattcaccaaagaatggtcatcagattaattcaaggtcaacatgaaagaacaaatttcaaaagcagttagatagaagtgtcaaatcacctataatggaaatcccattagactaacagtggacttctcagcagaaaccttacaagtcagaagagactgggggtctatttttagcctcctttaagaaaaaagaaatgtaagtcaagaattttatattctgccaaactaagcttcaaaaatgaaggagaaataaagccttycccagataagccaatgctgagggaatttgccactactagacaaatcctacaaaaaaattctcaaaggagttataaaaatggaaacaaaaggatgatactcaccatcataacagcatacataagtagacaaagctcactgtataaagcaattacacaactgagactataaataaaccagctaacaacactatgacaggaataacacttcaaataccaatattaatgttgaacataaatggcctaaatgttccatttagaagacatggactggcaaactggataaaaaaacaagacccagcc

SEQ ID NO: 205995 - DNA, 601 bp, Human
atatttgagggaaataattcaggaaaatttccccaaacttgctagagatgtagatatgcagatacaagaaattcagagaacccattagagatactatagaagatgcacattcaccaaagaatggtcatcagattaattcaaggtcaacatgaaagaacaaatttcaaaagcagttagatagaagtgtcaaatcacctataatggaaatcccattagactaacagtggacttctcagcagaaaccttacaagtcagaagagactgggggtctatttttagcctcctttaagaaaaaagaaaygtaagtcaagaattttatattctgccaaactaagcttcaaaaatgaaggagaaataaagccttccccagataagccaatgctgagggaatttgccactactagacaaatcctacaaaaaaattctcaaaggagttataaaaatggaaacaaaaggatgatactcaccatcataacagcatacataagtagacaaagctcactgtataaagcaattacacaactgagactataaataaaccagctaacaacactatgacaggaataacacttcaaataccaatattaatgttgaacataaa

SEQ ID NO: 205996 - DNA, 601 bp, Human
gcacactagagggttgtcccagtggcctgagaggtgtccctagacccccgccaaggttggtgcttgtacctgccctggagagcctggtcacgggcttgccagacccagccatacccagctctgccgcctccagccagggtggtggcagagtgcaggacgggatccctgggaatcccgcccatggccagggaaaccctggtatttccccacatcaacaaaggccaaaaattccactgctattattgcaactgcctctcaactgcaagcgccacctactggcctgtagggtgaactgcataaytcaaagtaattccggctgacagtatacagcggtgggggatgagataagcctcctgaaacctccacctccccatttctctgtaggagacagtgagtctgaccactggtccagcacactgttactacaacctacaaacaactagcatttgagaaaaccactacactaaagctatctataaccaagtaattcataaaagccttggccccctaaaactacagagaagccaagacaaaggaacttaaccaacatacagaacagtcacatcctcaaggtgggggagggaagaaaaaataccaagca

SEQ ID NO: 205997 - DNA, 601 bp, Human
gcttaatagcctgcattgtcccacctgaagtgttttgttgttagcctgggagcagttcagtgtcccccaccacagctgaggcttgaccctgaggcctggtctcagctccccaggacgcagcacactgcccagggctatggagatgagacttgtggtctgatttcaaatactggaggagcccccactgtctgaacacagcaaagagtgtggtgcaggttcaaggggtggcatgggagccgggtgccccacccttagtgagaccagacccagaagggtgtggcctgatagccttggtttccgytgcagggagtcctgaggtcctgagtaccaggagctcagggcagtgcggatgacttgggagaagcctagctggttgggccagttgctagggctggatgctggagggagaaccacagggttgggggagtgtgagctggcagtctccagggctacctgctgggctaagcatcccagttgctcctcctactgaagagactctgttgcgcaggaaaggcaactgtgctgcacactagagggttgtcccagtggcctgagaggtgtccctagacccccgccaaggttggtgcttgtacctgccctg

SEQ ID NO: 205998 - DNA, 601 bp, Human
acatgattatatggctctactcaccataatgagaacacgcataataatcctgttcaattatagtgactcaaacctacttaaaaaaaatgtgcttaatagcctgcattgtcccacctgaagtgttttgttgttagcctgggagcagttcagtgtcccccaccacagctgaggcttgaccctgaggcctggtctcagctccccaggacgcagcacactgcccagggctatggagatgagacttgtggtctgatttcaaatactggaggagcccccactgtctgaacacagcaaagagtgtggygcaggttcaaggggtggcatgggagccgggtgccccacccttagtgagaccagacccagaagggtgtggcctgatagccttggtttccgctgcagggagtcctgaggtcctgagtaccaggagctcagggcagtgcggatgacttgggagaagcctagctggttgggccagttgctagggctggatgctggagggagaaccacagggttgggggagtgtgagctggcagtctccagggctacctgctgggctaagcatcccagttgctcctcctactgaagagactctgttgcgcaggaa

SEQ ID NO: 205999 - DNA, 601 bp, Human
tctgttttaaattaatgatattatttcttgatataagggataactgaagcactacacatgattatatggctctactcaccataatgagaacacgcataataatcctgttcaattatagtgactcaaacctacttaaaaaaaatgtgcttaatagcctgcattgtcccacctgaagtgttttgttgttagcctgggagcagttcagtgtcccccaccacagctgaggcttgaccctgaggcctggtctcagctccccaggacgcagcacactgcccagggctatggagatgagacttgtggyctgatttcaaatactggaggagcccccactgtctgaacacagcaaagagtgtggtgcaggttcaaggggtggcatgggagccgggtgccccacccttagtgagaccagacccagaagggtgtggcctgatagccttggtttccgctgcagggagtcctgaggtcctgagtaccaggagctcagggcagtgcggatgacttgggagaagcctagctggttgggccagttgctagggctggatgctggagggagaaccacagggttgggggagtgtgagctggcagtctccagggctacctg

SEQ ID NO: 206000 - DNA, 601 bp, Human
actgcaacccactacccagcgtgtaccaggtgggctccaaggcttcacacaaaaaggcttttgattccatgtggccctgaaggcctcaaattgggcagaccctgaagcctggaggtttggggtaaattacatttacttcagactagggcataaccaaccagggtaggctaaattaatctcaccaaaaaggaatgtaattctgccattatttttagttctgttttaaattaatgatattatttcttgatataagggataactgaagcactacacatgattatatggctctactcaccataawgagaacacgcataataatcctgttcaattatagtgactcaaacctacttaaaaaaaatgtgcttaatagcctgcattgtcccacctgaagtgttttgttgttagcctgggagcagttcagtgtcccccaccacagctgaggcttgaccctgaggcctggtctcagctccccaggacgcagcacactgcccagggctatggagatgagacttgtggtctgatttcaaatactggaggagcccccactgtctgaacacagcaaagagtgtggtgcaggttcaaggggtggcatgggagccgg

SEQ ID NO: 206001 - DNA, 601 bp, Human
cttaaaggaagaagtttaagaacaattggagttgaaggtagatcattatatctccacggccccaaactccactctggggcacctggttttttgtctcagtggcccccacggggttgatgtgtgtgtgggagtcattcaggcccctccttgctgtcaatcttagcacagaccctcactcttgcttcctgccacagtcttagaccttgctcttggataacttacaggctcagggaatctcatgactgcatccaaaagacctcctgactggctgtgagtctttgctcaaggctcagcagtaatygccttgtaaaaatagcaaatggggcactctctttgtcctcttcgagccctctgcagcataagatgtccctggacagacggcccagcctccagggtgcacacactgacccacagtacccgagatccacacctaccctgagaccttcacacagaaaccgagacatctgagggcttctgggccagcagctcttgcgaccagtttcatcccagtgcttaattatgatctagcatactttttagttcaaaagctcttttaggatgtaatgtaaaatggactttttagtaactctggtaaatactc

SEQ ID NO: 206002 - DNA, 601 bp, Human
tccatgaacaccgagcagctccaggccaagggatggagaagtagagtccagaggacgggagtctatcccttccaggcaagaccctgcagcaatgcacccttcccagaacacgaggtgtgtttaacaaatccttacctcgacagcccggaaaaagcagtcagaggagcaagatggcattttaaattgcgactgcctcttgcaagggagcgtgtttccgtctctccccactgtcccaggctggctgtgtggagcctgcgtgtgccctggggggcaggctgtctccgggcagcagggaggccamccacccacccgctgggctcccaggctgccttgcaccggctcccttagggagtgaatccagccacagtgatgcaatcaccccacggacttgctctcccactcccatacgacaagacccggacttgggggtgaggacgccaaccacaacaaccgcaacaacacaactctcacaccaactggtcagaaaaacccccgctcaatgctttcccatggcagtgaaatcacacacaggcagctgagaggctgaaacacgtgcgttctctgaatccagacccatctgccaacctccaaataatctttg

SEQ ID NO: 206003 - DNA, 601 bp, Human
ctaaagactttaacatcctgcaacacacaaaggggatagttacagataaacaacttcgggctttcaagaaataaaaactgaaacaaaagaaaacaggtaaagtaaaaatagtagtgctccaacacatgggcaactgtttttccaggcagccaacaggtccccaccagctgcagggatgtgactcttcctccctatctcccctttcccacctcctgggggcagagcaggtaggattacaacatgatactcttaaaatgcccaggacaactcatgggaacatacagcacacggctaaaccacyaaacctgtcttaagaagtgacaggattcacaggattcatttaaaatacgctggtggtctccaggttggacattttacagttgaaccaattgaaaaaacaagcaagcaacaacaaatcctgtaaatctccctcttcccatcataacctttgacgagtcgacctgttctcccagggcacagggtccagcagcggcacctacagcctttcccgcagcacctcacccctcacagacactgaggctcagggtggagtggagatgaattaatacaaaagaagggcataataaaaacatagtcacaa

SEQ ID NO: 206004 - DNA, 601 bp, Human
tggccagctctctccagagcacctcaagggcacctccctcctgtcccccgcccacaggtgtgcagcaagctccatgtggctctgacagctggggaggctggacaagccacagggaacctcgccatgtctgagcccttggcaagttattacctcaaccatccaaggcaagattcccaaagtactaggggaaaggggctggagggaggagagtgaaattttaggagaaacaggagagtcgaggggaacccagagactgcctgctaatttcgcaggggacactgcagtcacacatttggcattyggcagcagcggtcttcattcaattgcacataagcatccccaggtgccaatcctgttctgatggttccctacctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgcaacacacaaaggggatagttacagataaacaacttcgggctttcaagaaataaaaactgaaacaaaag

SEQ ID NO: 206005 - DNA, 601 bp, Human
cagctgcaatcctgtgcatggccagctctctccagagcacctcaagggcacctccctcctgtcccccgcccacaggtgtgcagcaagctccatgtggctctgacagctggggaggctggacaagccacagggaacctcgccatgtctgagcccttggcaagttattacctcaaccatccaaggcaagattcccaaagtactaggggaaaggggctggagggaggagagtgaaattttaggagaaacaggagagtcgaggggaacccagagactgcctgctaatttcgcaggggacactgcrgtcacacatttggcatttggcagcagcggtcttcattcaattgcacataagcatccccaggtgccaatcctgttctgatggttccctacctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgcaacacacaaaggggatagttacagataaacaacttcgggctttcaagaaa

SEQ ID NO: 206006 - DNA, 601 bp, Human
tagagaaaattttggttttgaatattttactatgactttgtaagaactatatttattagataagaatttaagcaaaagtctgaaaagcttttttacctaaaataagccacctgaacaaaatacctcaatacgttctgtaaagagtcaatatcttcaaatattctgtgatacaaaatattctcttactttttaggcatgacatgggcacacacatatacacgtgcatgaacactgttcaaagccttattaaccagcaggcagagatgccatgtaagactcaactcaaacttacagcaaagtrcttcataatttgctccaattcccagcggacctctctgcactttgctgcctataaccatggctcccttcttcccatgagctgaggagctgatctcagaagggcagctgcaatcctgtgcatggccagctctctccagagcacctcaagggcacctccctcctgtcccccgcccacaggtgtgcagcaagctccatgtggctctgacagctggggaggctggacaagccacagggaacctcgccatgtctgagcccttggcaagttattacctcaaccatccaaggcaagattcccaaagta

SEQ ID NO: 206007 - DNA, 601 bp, Human
aacgggactggtggtgagaaagaaaactgaggaaggagaggaaggatattctaaggaatttcatgtatcttcaaatcccggctgtgtgaggttcgttatttttttattttttattttttttgtgaaacaggacccaaaatttgacacaaatattcctcttttttttttaatcatttcacttgtttccctttccctttttttccttttatacttaattttacaataaagtgtcatcgcccactagaatgtattaagtccatctataaagaagagaaagaaataaggtatgtaaatatcacawccctacaaatcctgtgtgcttatggacatttcttttcctattctctcagagtaaatggttcttcatttggttaaagttttaatgcatcatttatttatctaccatatgatagtctagaaatcaaagggtatcacatgaaatagataattcaaaatttctgaaacattccttatatgttaaaattttatgtatgtatatctgtacccaatttctatgtgtcctgagtgtgtccaattatattcaagtactaaatgtccgcagaagtccttttcatagttctttcaaatgaaaagaatattg

SEQ ID NO: 206008 - DNA, 601 bp, Human
atggctaagaactccactccagacactgagactgagaaacatccccaacaggtagaacctgggggcagtgctaacataggaagggaccatttaaagggacaagtgaactgggaatcataaaacagaccatcattcactagggcttcacctaccagggcaaggggctttgcaacaactttttcaagtgcgtccagtagtgaatgtccccaggagctaacgctgggaagggccacctgacctcagtctgctcataggagtcgttctctgcttatccacaagcgcagcacagagcgggcaggamaaaccaccctcagcgagaggggctactctgccgagtgacagcagggatgccactgttgctgccaatggagggtgaccagcatctcagaggagcgatgccctccaggctgcagacacccacgcatggtgcttttctcccgcagaaagggaaccacctgctgcaggctatcttgggaactaccctcactttttctaaagccatcacttccttctgggtatagaaaaggtttaatattattaagggactgatattttagctgttaagatccttatacaggttgaatatcccttatcctaaatg

SEQ ID NO: 206009 - DNA, 601 bp, Human
ctccatgtgtgaagctgccctggctaaggtgaaccttccagagacttgcagctcaccatgctcggggcagaagggatggggacaccttccaaaaaacctgccccattctggcagcctcagctggacttactgtcggctgttgagtggcctgggtcagggacagtgttttcatggctaagaactccactccagacactgagactgagaaacatccccaacaggtagaacctgggggcagtgctaacataggaagggaccatttaaagggacaagtgaactgggaatcataaaacagaccatyattcactagggcttcacctaccagggcaaggggctttgcaacaactttttcaagtgcgtccagtagtgaatgtccccaggagctaacgctgggaagggccacctgacctcagtctgctcataggagtcgttctctgcttatccacaagcgcagcacagagcgggcaggaaaaaccaccctcagcgagaggggctactctgccgagtgacagcagggatgccactgttgctgccaatggagggtgaccagcatctcagaggagcgatgccctccaggctgcagacacccacgcatggtgct

SEQ ID NO: 206010 - DNA, 601 bp, Human
tcaacctaattctcaggacaacggaattcctcaaatccttgaaatttgtaagatctggcggaaaccctcttctctttactgtgttctctgtgtaagttccagcctctctcccagattatctgaccttagtatgcctgatgtctacagttacttggggcctgggtgcaagagccccaggcaccaggtgccccccacattcccagggatgggtttatctgcaatcccattttcaagttcagggggcatcaagatactagttttgtatgtttaaatttgtatttttcaaaattccttttatctyttttttttttttaatttttgaggcagggtcttgttctgtcaagcagctggagtgcagtgatgcaaacacagctctctgcagcctcaacttcctgggctcaggtgatcctcctgccttggccttccaaagtgctgggactacaggcatgagccactgtgcctggccaaaaatatcttttaaaatataatttgtttacttgatatgtctgcaggctgactgtttaatatcactgcatcctccatgtgtgaagctgccctggctaaggtgaaccttccagagacttgcagctcaccatgctcg

SEQ ID NO: 206011 - DNA, 601 bp, Human
aacctgtgctgccagttggcagtggaggggccatggcagagccggtgcacggaagctgtgcaccccactgtctcggcctcacatcgagctgcagcccttgggccactccctgcccatcattcctcagcacagcccacccaagggagagaaaagagctgtcagcaagctcagggctttcccaggctaagaaactgtcaacagagtaatcagtgagatagccctgacgtgtggataaggccgtaagtggacttctatttataaattttagtgggggaaaggacatcttttgttgcttttcacrtacaaaagggagagagggacataaaaccagcctgcaaaaggccccctctaatcagcaagagtcaacaggcgccggctgtttctccctccacacctttctgcatgtccagctgtcagcatccaacagcgtggcagccacaggacctccagagttactgccacggtgtttcccatctgaccaggaacaaccacaaagctgtaaacagcccgaaaaggacttgttgctcttcctgtttcaacctaattctcaggacaacggaattcctcaaatccttgaaatttgtaagatctggcggaaacc

SEQ ID NO: 206012 - DNA, 601 bp, Human
gttaaatgggaacactacttttcaagataatattccaaaaataatttcaagaaatggaaagggcaaaaattccttgaagtacatttgtatttttcaaatttctgaaactaatgctggcattactctactcctcaagaaaaaatatttaaatatcaagacaactcaaaaaagagaatcttacttccttgccttaacccttgcagctaaagtgtgactcctcggcagaaacctgtgctgccagttggcagtggaggggccatggcagagccggtgcacggaagctgtgcaccccactgtctcrgcctcacatcgagctgcagcccttgggccactccctgcccatcattcctcagcacagcccacccaagggagagaaaagagctgtcagcaagctcagggctttcccaggctaagaaactgtcaacagagtaatcagtgagatagccctgacgtgtggataaggccgtaagtggacttctatttataaattttagtgggggaaaggacatcttttgttgcttttcacatacaaaagggagagagggacataaaaccagcctgcaaaaggccccctctaatcagcaagagtcaacaggcgccg

SEQ ID NO: 206013 - DNA, 601 bp, Human
agtgtgcttttctgaggctggtgactccagagggcgcctaccatccccagaggtgggtcccaagacaaacaaaacatcaactcccttttcgtcactcacagcaggtcagtgaacacaacgtggcaggtgacccctttctcagagatccagagctgtgcagcctccggatgcagctgagtgcccctggcacaaatgctccaggcaccagtgttccagttggccgtcgactgcacatctgttcaaagatcttccctccagttttaattttctccatgatttaaagatatgtattttcaaatgrccttgcatgattataaacaatcacatcactatctataaactgcatatgattacaatggcctaagttaaatgggaacactacttttcaagataatattccaaaaataatttcaagaaatggaaagggcaaaaattccttgaagtacatttgtatttttcaaatttctgaaactaatgctggcattactctactcctcaagaaaaaatatttaaatatcaagacaactcaaaaaagagaatcttacttccttgccttaacccttgcagctaaagtgtgactcctcggcagaaacctgtgctg

SEQ ID NO: 206014 - DNA, 601 bp, Human
cttggtgccctggcaaaggggggcccaggaactcgggataaccggtgggctgtgaaactgactgtgtatcctgacagaagtgtgcttttctgaggctggtgactccagagggcgcctaccatccccagaggtgggtcccaagacaaacaaaacatcaactcccttttcgtcactcacagcaggtcagtgaacacaacgtggcaggtgacccctttctcagagatccagagctgtgcagcctccggatgcagctgagtgcccctggcacaaatgctccaggcaccagtgttccagttggccrtcgactgcacatctgttcaaagatcttccctccagttttaattttctccatgatttaaagatatgtattttcaaatgaccttgcatgattataaacaatcacatcactatctataaactgcatatgattacaatggcctaagttaaatgggaacactacttttcaagataatattccaaaaataatttcaagaaatggaaagggcaaaaattccttgaagtacatttgtatttttcaaatttctgaaactaatgctggcattactctactcctcaagaaaaaatatttaaatatcaagac

SEQ ID NO: 206015 - DNA, 601 bp, Human
agttcttgtcaaccgaattacacgtgaaggcagggaagaaaacacactccatcctccagcacccgctgtggacacgtacacacacacacatgcacgtacgcacacgcctccttcacagcatcttacatagcagcactgtcccccagaaagggaaaagtcgcttccctcactgtgtgaacacagtggttccaagtggagcgggaagaactcagcatactctagaacagcgtgtgcccagagaggccgcactgctccctttcatggcagttacgtcccttcccaggcacctcctcagaaactrtcatgggaggatggtggccatgggaaactaaccttattaaatcatggaataaacaagatgaacaaatgtacagcagggtcaaagtgtgaagtgatgccaaaatggtacagattaacatgctatggaattgacaccagggtagttctgttatcctaagaccctaccctcctctcctgcagccagactggaatcttgaggaaagtttcatcttggaaggaaggaatgaagttaaaggcaaaagcatttctgagtcaaagtgatctcagaatgcagaaaagactttccatctacaacgaacaa

SEQ ID NO: 206016 - DNA, 601 bp, Human
aaatgattttgcccttaaattgagaaatttcaactcttgtaaagactataacaagtgagaaaatattcaaagacaaaggagaaagaacttgaaagaggtggaggagggggatgaccaagaaggtgcagagatggaaggagatagaagctttttgatgacatcaaacttggttgccagaaaagatggtgctgtgtactgtgggagaggccgtgatgcacagcaagactgtacgtacatactcatctttcacactgaagcccgcacgcacatcatggaatagttcttgtcaaccgaattacaygtgaaggcagggaagaaaacacactccatcctccagcacccgctgtggacacgtacacacacacacatgcacgtacgcacacgcctccttcacagcatcttacatagcagcactgtcccccagaaagggaaaagtcgcttccctcactgtgtgaacacagtggttccaagtggagcgggaagaactcagcatactctagaacagcgtgtgcccagagaggccgcactgctccctttcatggcagttacgtcccttcccaggcacctcctcagaaactgtcatgggaggatggtggccatg

SEQ ID NO: 206017 - DNA, 601 bp, Human
tgctgacacctctcgccagaacagacacatgctatggtcagaagggcttctgaagacaccaccagaacagagctctgaaactcttatcttttagatgctgaaacaaatttggtgataacaacgtagaaaaagggcttatgaggagaattctgtaggaactacattttagtagtttctcttacatgtaatgtcacctggatcttgttggtggccttaggaaatggtttattctctcacttttaacatgtacacaggcacatttttagggtgtagctgtaacattcccattccccactcccakcttccccggaggagtgtgtgtgagagctgggcacagaggccctggtggctccctccactggaagaggaggtggggagagaccaggttttcttagaacagactttatgaatcaggacaattaaagcaggtttctttatttgtaatatatggcaagttacttttaaaagtctgttgtggtaacccgatcatcttttactatagactctgtgcttctgcagagatttccaagcagctaggcggtggcctgacctgggacccctgctcagaaaggagctggggagggagccctgagactggggt

SEQ ID NO: 206018 - DNA, 601 bp, Human
caagaagagagcagacaagagtgtacatgggagcaaaggagcctccggcctaagctctcttttgagggcctgcagctgttttccatctcccaccttcttctcactggggatacatgcaagcctgcagtttatttcatgaaatatctatgatacataaagttacactggcattagggtggcaatagtctatcaaacatctttacagctagcttaaatcccaacttatgagaactaggccagtctctgaagtgatggggcagccaggggtgtctgctcccaacccgcagtgggggtggggctrggcaggtggggttcttaggcctgtattatttattacctagtttctgagcgagaccaggaaacctgtgactccaagttcagctgctgcacaattagcttattaagaagttgtcctgagcttggaggagtctaaggtgcatttaaaaatgaagcccaggttcactctgaggacctggggggagtgactgtggcagaattagggctggtggtggtagcttttaaagctcacctttgaagttcccttggtggagcaataaaggccagatctccgcaaacacacatacagctttttccatgattt

SEQ ID NO: 206019 - DNA, 601 bp, Human
aggccactgagaggaggggctgctgcagggcttagccaagaggggcaacccctgaggagctcagggattctgatgtctgagcagccccaagatcagaccccaagtagaaggtccagagagggagactgatgttggctctggagaatgagacagaaggggaagtaggcaccatggggagaagacaggtgcccctccagaggcagggccctttggtgagggaggagaattgttgcaggcataaactgacctgcatctccagaagaacccccgacctcagactcaagaaacaatgctggacacrccccagctctccctcccaagaatctggaggggttgagggacaggtgtgactaccctgcgctcggctggtgctatgagagaagcagagactgcgtttgcagagacaggcaagcatggctggtgtgggctggtgggaagggagagtgccagctgctgctcatacctccagccccgcctgaggctgccttgggcctctagctggtgtgaattagacgcctattacttataaccgaaagagtattccctgagcaaggtatgaggtgatattttggaaagaaattttcccctaaggaggggctcc

SEQ ID NO: 206020 - DNA, 601 bp, Human
tgtcgacggactggattctatgggaggagaacctgccttctgacttacaggaggagagatcttaaagttgcccccaggccactgagaggaggggctgctgcagggcttagccaagaggggcaacccctgaggagctcagggattctgatgtctgagcagccccaagatcagaccccaagtagaaggtccagagagggagactgatgttggctctggagaatgagacagaaggggaagtaggcaccatggggagaagacaggtgcccctccagaggcagggccctttggtgagggaggagarttgttgcaggcataaactgacctgcatctccagaagaacccccgacctcagactcaagaaacaatgctggacacaccccagctctccctcccaagaatctggaggggttgagggacaggtgtgactaccctgcgctcggctggtgctatgagagaagcagagactgcgtttgcagagacaggcaagcatggctggtgtgggctggtgggaagggagagtgccagctgctgctcatacctccagccccgcctgaggctgccttgggcctctagctggtgtgaattagacgcctattactta

SEQ ID NO: 206021 - DNA, 601 bp, Human
acaagactttattaagtgcctaccatggactggccccaggttgtgtaccacttagctgaataataagccatcctttgggaacttcagaggagacagaaaaacaaactagcacaggacaacgtaatgtggtaagcacaataggacaaagaggaagaggcatctaactctgtcgacggactggattctatgggaggagaacctgccttctgacttacaggaggagagatcttaaagttgcccccaggccactgagaggaggggctgctgcagggcttagccaagaggggcaacccctgaggakctcagggattctgatgtctgagcagccccaagatcagaccccaagtagaaggtccagagagggagactgatgttggctctggagaatgagacagaaggggaagtaggcaccatggggagaagacaggtgcccctccagaggcagggccctttggtgagggaggagaattgttgcaggcataaactgacctgcatctccagaagaacccccgacctcagactcaagaaacaatgctggacacaccccagctctccctcccaagaatctggaggggttgagggacaggtgtgactaccctgc

SEQ ID NO: 206022 - DNA, 601 bp, Human
ggatctaagctcagttctggctctaggtctcatggcacatactcatttctaagataaaaatacctagaacatgatgcaaaggtctaatacaggaacgactgcactccagcaagagaagagcaagaacaggacaggggaaatatttgatgagataatgccaaaaactttccaaagttgacaaaaagacgtcaagctacagattcagggtgtaggataagtaagcccgctccgagcatatatcatggaaaaattgctgagaaacagacacaaagaaaatgtcaaaaacaaccagaggaaaacrtgcattattttcacagaagcaatgggaagacagacaactaatgtttttacataaattataagattcagaagacaatgcagtgggaagatgcagaagagaataaccgctaaccttgcatcctataaccagtgaaacgttccttcaagaatgaaagtgaaacaaaaagtgagaaaatttctcaggcccacatgaaaagaaccgctaagctgaggtcttctagtcccagagagaagaatgcaaatttaggaaatattaaagtgcaaagatgtaggtgattaaagagtatataaaacaataaca

SEQ ID NO: 206023 - DNA, 601 bp, Human
tagtctgcactttctgatcctggcaatgaggactcagggccctgcaaagtctcatacacatccagcatcccaacctacacacccaaatcacacattccaaccatgtggagaagaagaaagagtcagaaacaggaagtgaagtcatcaagtgggacagctcttctttcatgggatctaagctcagttctggctctaggtctcatggcacatactcatttctaagataaaaatacctagaacatgatgcaaaggtctaatacaggaacgactgcactccagcaagagaagagcaagaacaggwcaggggaaatatttgatgagataatgccaaaaactttccaaagttgacaaaaagacgtcaagctacagattcagggtgtaggataagtaagcccgctccgagcatatatcatggaaaaattgctgagaaacagacacaaagaaaatgtcaaaaacaaccagaggaaaacgtgcattattttcacagaagcaatgggaagacagacaactaatgtttttacataaattataagattcagaagacaatgcagtgggaagatgcagaagagaataaccgctaaccttgcatcctataaccagt

SEQ ID NO: 206024 - DNA, 601 bp, Human
gaagagctgactggttttggaataagcgggacagtgacaaacataataacatcaagagcaagtaatcttattgagtgccactatgggctcaatatgtctaagacactatgtgtctaagtgctttatgttatttcatttaatcctctccattttatgagctgtacactataattatccccatgttacagagcacagaactgaagcacagaggaatgaggcaagctgcccgcagtcacgactttgaacgtacacgacctgttccagacccagtgccctccctagctgaggcttgccacctaaytggctcagtagtctgcactttctgatcctggcaatgaggactcagggccctgcaaagtctcatacacatccagcatcccaacctacacacccaaatcacacattccaaccatgtggagaagaagaaagagtcagaaacaggaagtgaagtcatcaagtgggacagctcttctttcatgggatctaagctcagttctggctctaggtctcatggcacatactcatttctaagataaaaatacctagaacatgatgcaaaggtctaatacaggaacgactgcactccagcaagagaagagca

SEQ ID NO: 206025 - DNA, 601 bp, Human
tactccagaaacatgagcccatttttttactacaacatgcaatttattggagagaggacctgctcatggggagataattagcaacacaaggtgggtttctaaatggatatgtccaacatctgagttcactgtactagcaacaggaggtggctacaaaattatgagagtaatacagcagggactatagttaattttatgcagttctgaggtaatccgcatctttgtttgtttacatctcttgactacaaatggtgccatatacagtctgtgtttgcatgcattcagttttgataaattttamctttatataatagattaatatatataaaaaaatctctaagtggacctgcacagttcaaatcattcaacttcacattcaatatggtgcatgcctcagtgctgctgctactgtggcccctcaggagggaagagctgactggttttggaataagcgggacagtgacaaacataataacatcaagagcaagtaatcttattgagtgccactatgggctcaatatgtctaagacactatgtgtctaagtgctttatgttatttcatttaatcctctccattttatgagctgtacactataattat

SEQ ID NO: 206026 - DNA, 601 bp, Human
atactggagaggagaagccacagttagtcaccggcccgggagccccgaggcccggcatgtgacaaacgccacagcaggaaagggcaatgttgagtgcggaacagggagtgatgccctgtaccagcctccaggagcctgagtgccgctgaccctgatcaacacagggattaggagcaatgacgccccttgaaataaaaaatccgagtatagcttttgactcccccaaaacttacctactagtggcctactgttgaccagaagccttaatgataacataaacagttaattaacatatatttcrtatatgtattctacaccatatttttataaggaagctagagaaaaaaatgttattaagaaaatcataagagacaatacaattatgggactgtactgcattcgattctgtaagtctacatgttgacacaatgaattatctgtgtggtgtggagggcaaccattcaatctctagtatgtatcaagcaatttaagtttttcttgtcatgtcgtgacttttctctgttcttgggcgcacttccagcttcactagtggcatttcacatgggtcccatggtgttctttaaagttcctgtattgcact

SEQ ID NO: 206027 - DNA, 601 bp, Human
gactgtattttgagaagatgaagtgcttctgctcctttgagaacagagtgcccagaacacaagaggaacgatgacaatctctaaattctcaccagggaatgaatgcagcgttaatagtcaacagctcccatgggtcccaaggtttaaggaacaaaagcgaaaggcaggaaaggcagtaccccacaaggccagaagttgttgctgccatttttgagcacttaaagagagccacctacttacacaaccctgaggggagatgcagggacgggagaagaacggcagaggaattcactccctgtcrttgcactgttgagactacaaaacccacgtcatcgtgggacatactggcttccctgaaatgcacacacactctccagagcttctcttgcccaccctgtgtgaaatgaggcgtccttaacacatgtgatgcagaagctgaaaaggcactagacttctgaagctcctggctttacttaccactggcgtcgagaacggggacagcaaggccttcctctgctgagggattcggtaattctggtaaaggagcattccatactggagaggagaagccacagttagtcaccggcccgggagccccgag

SEQ ID NO: 206028 - DNA, 601 bp, Human
gaaaaatccattgccacgagggagttctcggagacactgcgctgaaaaggaaaggccgcagttcttaaaatgcagggaaataaggcagagtggagtcttggcatgaaactatcatcaagacggtcaggaaaggggagcagggaatgcctgctttctacctctgaactccccaagtttcaggtgggaaattcaccggttcaggctgaaaattcagtggccccttcagtttttcttaagaacgaaacacattctagtcctccctgagtattaaaaaggctgctggtgaggcccccggcacccrcagcatttggaccatgtggtccttcacaggctcctgacctgcactccaacacatcaaagaaatcaacagccagggtgagcctaggcctccccagtgagtcattccctcggggacgtgggttcaggaaaactcgtggaccctttctgtggcaccatttggcatctcaaaggggcagatgctgaaggaccctcaggactgtattttgagaagatgaagtgcttctgctcctttgagaacagagtgcccagaacacaagaggaacgatgacaatctctaaattctcaccagggaatgaatgca

SEQ ID NO: 206029 - DNA, 601 bp, Human
catcatcttgggcaacttctcttctcagcctcaatttcttcatctgcagaaggggaacaacacctctttttttttgagatggagttttgctcttgtcacccaggctggagtgcaatggtgcaatctcagatcactgcaacctccgcctcctgggttcaagcgattctcccctctaagcctcccaagtagctgggactacaggtgcccgccaccacacccagctaattcttacatttttagtagagatggggtttcatggtattagccaggctggtctcaaattcctgacctcaggtgaccygcccacctcggcctcccaaagtgctgggattacaggcatgagctactgcacccagccagaataactcttctcttacaggaccattgagaagaccatggctgatgtatatacagctttgtgcatgatcacacgcaatacaaggtagcttgaaataacaatcactgcaatcagccaactgccacaatccagtgatttctaaggggattgcagttataggaaagatgcccagggagaagctaagcatgttaagtgactactaaccaggctcagaagttgtaaacacggcccaggatggacagt

SEQ ID NO: 206030 - DNA, 601 bp, Human
tatacatcagaaagcgaagaaagatccaatgaaagctacaaagaagaaatggcctgaaaaggaactcactttaaatgtatccaaaaccaaactacaatcatcagcaaaatcaccaggtctagattgtaatgtgaagatggaaagcagttaaataagactggaaaatcccatgctgaaaaggtaaaagaaatatattttactacaggacttctcagagccttaaatatgtgaatattcatggtaactgcctagcagttttccaatcttacctatgtagaaacctcccccaccctttctaaartagcactttgcaggccttgtgtgcttcaggatatactttgggaaacaccgatcagaatgggattccatggtttggcttggtcaggccagatgggacggcgtgaggaagctcagaccccactggggaacacgcggcaccgccagagagaagacaaggagatccagttcttctcccaagcgctggtgcatgctgggcagctgtgcccacctcaaagacttgtcagagtcatgtcattccaaataaaacatcgttactctgacacccagaagtttgccgagcttcagctctaactagaggaaa

SEQ ID NO: 206031 - DNA, 601 bp, Human
cttcagtgcagtgctttggcatttaagtggcctctaggggcaacagcacaccaggcaagcaccaagacggtaattctgaattgtcattctccattggaaaaaagctgggctccttggggatatgcctgactacagggttagggcagggaaactataggatgaaaaggattattttgtgcctgcatatcaagaagtgctcaaagaataatgaggacatgtcaaaaagacacaggaggcaggatgactaaatctgggcatcaaaatgaattttaaaagtaatgaatcataacccatgaaatcrgaatccgtgtctgtagtattatttaaaaataaataagcaaataaattaatacgggagaagatgaaaatctttcttggaggagaatgtcagccaataaataaaggcaagatgtattcaaaaactaccctttggcaattactgtagtaactaacaattaacgaaggaggggggatcttcaacaaatgctgaaaccagcagatgaaaggtggatgagaaaaaagagtattttcatggcatcaaagtattgtactgttaatacttatttactacaaaggggaaaataatagctttacagtggag

SEQ ID NO: 206032 - DNA, 601 bp, Human
tttctttcttttttttttttaatttactcatccagcctaaaatgtcaatcacttttcattttagattttgagctaaaagaattataactgtgtgaataatataatgcagtagaagaacaaaaaggatcgtctatgcagcactttccctaggacagtaattcctgtatttgcatataaggttggctggaagctgggaaggctgggctcaaccccagattctgttcctcaccccagtgcggtgcagggaaagccactgacagccatgagcctcattttcctcacgagtaaggtggggatgtcrgcacacagcaggaagcaagcagccacagaaaagacagtgcgtggcacactgccttcccctggctcacaaaagctaagcaagacaccctcctcatcctgtatggtccatggctgccagtcactacacgattcttgagatcataacaaagtcctgggggtcagataagcctgaagaactccaggttcaactgtgtaaaacaggtgagtttagttaatttaagccttctcagagctttttctttgctgacatgcagattgaatctctgagaggaaactgtccagccagcctcttttggtagag

SEQ ID NO: 206033 - DNA, 601 bp, Human
cactgctgaaaggaggtcgtgttgttcacagggaataggtcagccttaaggcttggctaattaatgagcttggaaccacttcgtaactctaaaaccactgctagagctaacagcacatcccacagccagttttcacacacagaggctgcacacctaatgccctaagtcccaagttgctgttcttttgttacttgtaggatttgggcattacacactctgcctaccatgaaagccccctttctttcttttttttttttaatttactcatccagcctaaaatgtcaatcacttttcattttakattttgagctaaaagaattataactgtgtgaataatataatgcagtagaagaacaaaaaggatcgtctatgcagcactttccctaggacagtaattcctgtatttgcatataaggttggctggaagctgggaaggctgggctcaaccccagattctgttcctcaccccagtgcggtgcagggaaagccactgacagccatgagcctcattttcctcacgagtaaggtggggatgtcagcacacagcaggaagcaagcagccacagaaaagacagtgcgtggcacactgccttcccctggc

SEQ ID NO: 206034 - DNA, 601 bp, Human; identical to SEQ ID NO: 35498

SEQ ID NO: 206035 - DNA, 601 bp, Human; identical to SEQ ID NO: 35499

SEQ ID NO: 206036 - DNA, 601 bp, Human; identical to SEQ ID NO: 35500

SEQ ID NO: 206037 - DNA, 601 bp, Human; identical to SEQ ID NO: 35501

SEQ ID NO: 206038 - DNA, 601 bp, Human; identical to SEQ ID NO: 35502

SEQ ID NO: 206039 - DNA, 601 bp, Human; identical to SEQ ID NO: 35503

SEQ ID NO: 206040 - DNA, 601 bp, Human; identical to SEQ ID NO: 35504

SEQ ID NO: 206041 - DNA, 601 bp, Human; identical to SEQ ID NO: 35505

SEQ ID NO: 206042 - DNA, 601 bp, Human; identical to SEQ ID NO: 35506

SEQ ID NO: 206043 - DNA, 601 bp, Human; identical to SEQ ID NO: 35507

SEQ ID NO: 206044 - DNA, 601 bp, Human; identical to SEQ ID NO: 35508

SEQ ID NO: 206045 - DNA, 601 bp, Human; identical to SEQ ID NO: 35509

SEQ ID NO: 206046 - DNA, 601 bp, Human; identical to SEQ ID NO: 35510

SEQ ID NO: 206047 - DNA, 601 bp, Human; identical to SEQ ID NO: 35511

SEQ ID NO: 206048 - DNA, 601 bp, Human; identical to SEQ ID NO: 35512

SEQ ID NO: 206049 - DNA, 601 bp, Human
cttcctcttgcgttcagctcacccctggccagatagggtgctagtactgtgaactgtattctcttttagcttccgaaccctgcaggtaccgggggagtcttatttaaagcttcttggagttagcatctactgattgtctatgaaatatatattgttagggagtgggtgcctttcctggtaggatggagcatataggggttatggttacgtttctgagataaggaaatctcagcataaactctacatttagtgagactgaagactgctatttctagaatgttacccctgcccctccacaacyccagggataacagactcttcaggctatctaagtggaaggtctcaaatgtgggttttgggggaaaatgtaatgtttcattctccaggaacaaataatcttttaggctgctattgctggggcatagaggagactagatctgggatggcaagggggtcaaatcctagaagttcccatctgtatttggtgtacctgttaatgaagctctcctggaacaggggtaaggaaaatggagagctagtcccttggatgagagcattcatttgttttgatctacaggtcagtctcctgagtcaaaacccc

SEQ ID NO: 206050 - DNA, 601 bp, Human
agcttgtcacgtatctgttggctcacctggctggtgtagggcagcagccaagcccacagcaatgtcagctgcattgctccttccctcagtttttctggctccaggaccaggtgtgcacttacctctaacaaatcatcagcttttgctgcataacatccccatcattgaggctggagacttggggacagtgagagaacaatgtgggttccagtccaccctcaccctcatgggttccaactggccctttttctcccacttgacatctatcttccctttctgctgtgcaaactgtagactgctgctgcagcatcaggacagaaacagtatcctaaagtacactgtttaactagcacccacagttgcatataatcaatatctatatccacatcattatagctatatctataatctatagtacctcctaatggttctgcttctcttatcaaaccctgactgacataataaagatatgacatgtgaaaatttgtagatgaagctgatgcagcccttaaagggaccatttagcctaaaatgcatgcgttgttaatagaaatgctaatgatcaattatctaagctcctatttcaagaaatgaataacaa

SEQ ID NO: 206051 - DNA, 601 bp, Human
gttaatagaaatgctaatgatcaattatctaagctcctatttcaagaaatgaataacaagaaaatgagcaaaccgtaaacaaacaatagcaaatcaaacccaaagaaatcaaaaggaaggaaataataaagagtagaatgggacacaaatgaaatagagaaatcacacagtacagaaaattaacaaagccaagaatgaactctttgcaaagagtaataaaattggttagcctctcacatgactaaataagaaaaaagaaagaaaatacaacttaacaatgttagaaatgagaaagagaacrttagtaaagttatcaagaataattttatattgataaattttacaattttcagaaaatcaacaaatgccttgagaaatacagcataccaaaactgatgcaaaaacaaaaaatagaaaatgtgaatcttttaaagatatactctgttattaaaaaatctttccacaaagaaaactccacgaagaaaagcctcactgataaattctctcaacactaaaaaaaatcagtctttcacaaactcttccagatatttgacaaagtaaaaacactttataactcattttatgaaaccagcataacttt

SEQ ID NO: 206052 - DNA, 601 bp, Human
atgctaagtgaaataagctagtcacaaaaagacaaatactgtatgattccacttaggtgaggtacctagactagtcaaattcataggcagaaagtagactgccagttgccagagcctggggaggggaagtgaggaattcttaaaccgttgttgatggcctaatgggtataaagttccagttctgtaaaatgaaaggtctggattttacaacagtgtgaacatacttaacactactgaattgtagactcaaaaatgggtaagatagtacattttatgtgacatatttttacaacaatttttaaaaattgcacattgtttttggaaaaggtcatgaggctcacctgtttctaggcactcttgcccggcatccttggagggtcatctcctcttcctccttacacaggaaggtgatttctgaccttgctgactttttccagctcagacctggcctgcgttcacactgtttcagcataagcccattcctctcattcccctctcccacatggagggtcctggattttccctatcaagctatgtttcctctccagcatgacagcactcaggaccaggcctaggaagagctgtgagtaagagaggcaag

SEQ ID NO: 206053 - DNA, 601 bp, Human
ggagatggggtcttgctcttttgcccaggctggagtgcagtggcgcgatcttggctcactgcaacctccacctccctggttcaagcgattctcctgcctcagcctctcgagtagctgggattacaggcacgtcccaccacactcagctaatttttgtatttttagtagagatgggatttcaccatgttggtcaggctggtctcgaactccttaccttgtgatccgcctgccttgggcctcccaaaatgctgggattacagacatgagccacggtacccggccgatccatttttttttttttaagtggaggaattttttaatttttagtgtcttttggtaaattatggttttcaaggaattggtttatttcatctggattttcaaatttgaggtaaagttgttaacgaccctttttattatcttttttgtgtcttggggcctatggtaatgcctccttatttctgatatttctgataccactaccaatgtcattaaaccttctaaaaacaactctcttggctttactccctccccccacacccctcccgccaacacacacacacacacacacacacacacacacacacacactctctctctc

SEQ ID NO: 206054 - DNA, 601 bp, Human
tgtgacataaatttgttagccagtattcaggtttttaaaagcgtagtcagaggtttgagttggatgctaaagatttctaattttacaccagaagctagtagttagagttccagtatctttccctcttcctttttcattttatacctgcattgtccatggaattctaaccttttttgcaatgtttctgacttgcatggctttagacaaaaatcaaacctttaatttaaccttactcttattttaaggtgtacttgatgatttttagagctcttgggtttgtgatattcaacctaatattctrtgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcct

SEQ ID NO: 206055 - DNA, 601 bp, Human
ccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataacta

SEQ ID NO: 206056 - DNA, 601 bp, Human
ggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataacttycaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccac

SEQ ID NO: 206057 - DNA, 601 bp, Human
ttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacgctgcttcttttaataaatattatataattttmaaattttagattttagggagacatttttaatattataggtcttgtacaaatttccctttttctatccagccagaaagattttaagtcatacattatggagaacttggtttattttactaataagctgaagttatcaaaaaaaggtcaaacttaagttgagattttctgatatttcctagttcatatagttgccactagatggcttatttttgcttgagtagatcaggttactatctaaataatggcagtcttcaaaatgaaaattttaatctatacctgtatttctttttaaattttact

SEQ ID NO: 206058 - DNA, 601 bp, Human
tttttctcctgttctccaaaagtggtagtggcaaaattcagatcatcagacttagtcgatggagataaactttctaagctgtagattcactttcggatactgtttgtaatgagtttcatttacctttgagaaatttgagttacagagcttaaaagtgttttattcggaatatttttgagccttaatacttaatcattctctggagcttttggtaggtcttctgttctacttcaaattctctctacacctcctaccctcctgggacattgaacctctgtggcctcaacttttgacccatgayaaagctaaagctgtcaggactatctctcagagtgtttcctaatccccatcttcccccaagatgtttgaagatgtttaaatgagatcatttattcaaacatttaaaatataataaaaacttcattggttacgacaaaaggtcttaggtgaaattcaccatgctatctttgagaaaaggaacttgtagcaatagaaaactatgtggaaagcatatggtgaattgtaagctatgtggtcattttgaattttctatttagggcgactgatctttctctgccagtcttgaaaacttagagccaga

SEQ ID NO: 206059 - DNA, 601 bp, Human
gaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatcttyttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaac

SEQ ID NO: 206060 - DNA, 601 bp, Human
ctgagtcaccttgtggttctttgcagattgcaaccaaatgattccaaccttctgggttagactttgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgccttttttttttttttttttttggtgaatgcctgttccccccctccccccaccgtggcattatttgtatattttttggattgtagttcttgatatattttgaatgctaatccttgtcagttcaagagttacaaataatttctcccaatttggttatctttttcattcacttaatggttgtactggttgaatagatgttcttaatttctccttttcatgtagtttgtatgtctaaaagatgagtacatgaaaaaattcacgataccattatctacctaaaaaacaataattccttaatatcataaaatagttttaaaacttc

SEQ ID NO: 206061 - DNA, 601 bp, Human
agtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttcyggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaa

SEQ ID NO: 206062 - DNA, 601 bp, Human
aaaataaccccaaacttgaggggtttcaggaaaaaaaaaaaacaaaaaactccacaaaattgttttcctttccctgtacgcaaaagtaaaacaatccgagcttacgaaattgttaggcacacaaacttgcagttctgattactattgactttaggggaagaggtgaagtaactgaggtttgagaagtaaaataccataattgaaataattttgagtttataacatttttaatttttaagtttatatctgcctctgtcctttttctctccttgtacgtgtgtttctttattttgattttggygattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttgga

SEQ ID NO: 206063 - DNA, 601 bp, Human
gcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcmttttcaacctttatgtcctttaccaccacctttagctttttaaaaggaaacttgttttgtctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgt

SEQ ID NO: 206064 - DNA, 601 bp, Human
gggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgkctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgtcagtgctcttttgccctttgacagttatgtcagtctgtgtgtgcaagagtagggatggct

SEQ ID NO: 206065 - DNA, 601 bp, Human
ttatgtaggatctgcagaagcccatagtgtatgttaaaaatgagaatatttataatactcattatttgaggagtaggcttttgacattattgaataaaatcccctcgtgcttaagaattaccagatttttgcttaatacttatgtacatttcccaatgaaattcagataaacataaaaattaagtaactcttctgatactcccagtgatagtgttgactctttattcttccatttatcccctcggggccaatagattgttagagctagacaagcaatctaaatgttaggcagctgatgagsaacagacagtgatcttagcattttagtcttaggttccttctaagcagtgtaatagaatgatcaaggcaatacaaccatgtgatttatgttctataccaaaggtactcaaaatcagtgacataaaaaagaggtttatgtgtagtatacccaagcatttgggtttagtatattatgattataatctcttcctggtggtacacagccctcatggttgccaaggagggccttcccccagagtggagacatataattcatatgtgctttaatgctaatttttatttacttcatttgcatgtggtg

SEQ ID NO: 206066 - DNA, 601 bp, Human
atgtgctttaatgctaatttttatttacttcatttgcatgtggtgtttaatttcattgtcagaggtcaggaacccggctgtctcactagggttttttctgctacattttagtacaattctacttgagttaccgcctcatctcaacttcgttatcacaggaatgattacattcttcagtttttcctccttatgttgtctgtatatctgcaaactgagagatgtgagtctgcatagttgcctaggtctgaaacatgacccaaacatattagctgtatgactgtgggcaggttatttatgctakaataatgtctggcacatagtaaattcccctctgaattttaacatcatacctttttttcctcctaaccttggtaccttttcttcttccaatttattacactactcttgattaatactgatgagtctggagatagttaaatatgggggtgggggcaaataatttttaaaaccagtaaaattcttctattaaactttttacaacgttaaatcacttctgtggtaacatccactaacatttctaaatttgcaattctaaagttaattatggtttttgcctctataataaaagtgatagacaaat

SEQ ID NO: 206067 - DNA, 601 bp, Human
tgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaractatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaa

SEQ ID NO: 206068 - DNA, 601 bp, Human
tttattattttctggtatgagaagatgtttcaagcttatctatagtatttcctctgccccagctctggaatctgccattccagagtttttagaaggaagggtatttagaaatcaaaatccgaggtttaaatcttttttttttttttttttttttttttttttgagacggagattttgctctgttgcccatgctggagtagtgcagtggcgtgatttcggctcactgcaccctctgcctcctgggttcaggtgattctcctgcctcagcctcccgaatagctgtgattacaggcacctgccmtcatgcccggctaattattatatttttagtagagacgaggtttcaccatgttggccaggctggtctcgaacgcttgacctcaggtgatccacccacctcggcctaccaaagtgctaggattacaggtgtgaaccacagtgcccctgccaagtcatccttatttcattctaattgtggtaaggtgatacctcattgtggtttggatttgcatttccttaatgattagttatgttgagtgtgctttcatgtacatgttggccatttggatgtcttcttttgagaaatatctattcaagtctt

SEQ ID NO: 206069 - DNA, 601 bp, Human
tgatcacccaaatgttacacttcttttcattctgaatctttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcctggcctcaagtgaggctcctgcctaagagtagctaggactacaggtacacaccaccacacctgactttttttttttttttttttttttttttttgagatacagagtctcacactgtcgcccaggctgcaatgcagtggcgcagtctctgcttactgcagcctgtgccttctgggttcaagtgattctcctgcctcagcctcccgagtagctgggattacagat

SEQ ID NO: 206070 - DNA, 601 bp, Human
ttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagacttttyaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagat

SEQ ID NO: 206071 - DNA, 601 bp, Human
gcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgygagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctgttgactacacggcaagcagagtgatctctagaaaatatgagcatgttgctttcctgcttaaaatc

SEQ ID NO: 206072 - DNA, 601 bp, Human
gacaaaatcttagccttctaggagcttacatgccaaaagggatgggggaagagaaggcatacgagaagtatatcagataggaataagtgctatgggggtgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtatatgyccaggcatgtcaggaacatgcctgacatgtgaaagaacagcagggaaactggagtggatggaacagaggcggtaggggacggggacagttgtagggagtaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaa

SEQ ID NO: 206073 - DNA, 601 bp, Human
tgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtatatgtccaggcatgtcaggaacatgcctgacatgtgaaagaacagcagggaaactggagtggatggaacagaggcggtaggggacggggacagttgtagggartaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgaga

SEQ ID NO: 206074 - DNA, 601 bp, Human
taactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgagaccagcctgggcaacatagtgggaccttgtctctaaagaaaatagaaaaaataagccgggtatggtgaacatgcctgtagtcccaactactcaggaggctaaagtgggcagatcacctgagcccrgagaggatgaggctactgtgagccctgatcgtgccactgcactctagcctgggtgacagaacgagacccagtctcaaaaaaaatttttttttagctggatgtggtagcatgcacatgtagtcctaactagtcaggaggctgaggtgggaagattgcttgaacccaagagtttgaggttacagtgagctaggatgatgccactaaacagcctgggtgacagagggaaaccctgtctaaagtaaaagggactgactgttgtgaagatagaggcaacaggattagttgacagaaatgtgtttc

SEQ ID NO: 206075 - DNA, 601 bp, Human
ttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacarggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtc

SEQ ID NO: 206076 - DNA, 601 bp, Human
gaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatasagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttggg

SEQ ID NO: 206077 - DNA, 601 bp, Human
taaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttarccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggccttt

SEQ ID NO: 206078 - DNA, 601 bp, Human
tagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtstgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtg

SEQ ID NO: 206079 - DNA, 601 bp, Human
gtccaatgagattataatgtcgtatttttactgtaccttttctatttttagatgcacagattcaccgttggtttgcagttgtctacagtatgtagtacaataacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaraggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaa

SEQ ID NO: 206080 - DNA, 601 bp, Human
ttttactgtaccttttctatttttagatgcacagattcaccgttggtttgcagttgtctacagtatgtagtacaataacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacrtaaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacg

SEQ ID NO: 206081 - DNA, 601 bp, Human
tctttgctctgtcgcccaggctagagtacagtggcgtgatctcagctcactgcaacctccgcctcctgggttcaagcaattctgcctcagcctcctgagtagctagggttaacaggggttacaggcgtgggccaaccatgcccggccaagttttgtatttttagtagagacggggtttcaccatgttggccagtctggtctcgaactcctgacctcaggtgatctgcctgcctcccaaagtgctggattataggcatgagctactgctccctggcctttttttttttttttttttttttttggagatagagtcttgctctgttgcccaggctgaagtgcaatggctcgatctcagctcactgcaacctctgcctcccaggttcaagcaattcttcagcctcagcctctcaagtagctaggacgacaggcccaccacaccccgctaattttttgtagttttagtagagatagggtttcgccgtgttggccaggctggtctcaaattcctgacgtcaggtgatccacccgcctcggcctcccaaagtgctgggattacaggcgtgagccactgcacctggccaattatcattatcttaataca

SEQ ID NO: 206082 - DNA, 601 bp, Human
cagggaagagatgtgaagaatgatgcccaaaattctaacatgaacaactgtgagtggatagtggtaccatttactgaggggaaacacaggaggagaaacatgtatgtatgggaagaaaggggtgagttcagtttgggtagattgagtttgagcctgtgtgacacccaaatggagatatacagtagaacagtaagtaatttgtcttgaaatgtttttgaatcatctgaatgaagatatctagaacattaaagccgtgagcgtgggctagatcatccagggaaatcagtgtgagaagatagcstggcatgggaacttggagaaacatcagtttttaagagacaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtag

SEQ ID NO: 206083 - DNA, 601 bp, Human
acaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtagttattttgttgttttcatcctccttacaaatgagggtygcagtgttggttagtccctttagactctccaggctgtagaaagtgttcgtcttctggtcgggcgtggtggctcataatcccagcactgtggaaggccaaggcgggcagatcatgaggtcaagatatcgagaccacccaggccaacatggtgaaaccccgtctctactaaaaatacaaaaattagctgggcatggtacgtgcctgtagtccagctactggggaggctcaggcaggagaattgcttgaacccgggaggcagaggttgcagtgagctgagatcatgctactgcactccatcct

SEQ ID NO: 206084 - DNA, 601 bp, Human
gtcctcggcctcccaaagtgctgggattacaggtgtgagccaccatgcccagccctctttacggtagtttttaaatgctgctgggcatatatagtactaagagtctggaggaagatttttgctttggaatattttagccctgtaccttttttacgtgtttaatgggggtcttttttctgtctccttgtgactgaggttgataccatgtttatgaaatagtttaagaattaactttttaggctgggctcagtggctcatgcctgtaatccctatgctttgggggaggccaaggcaggagaakcacttgagctgaagagtttgagcctgggcaacatagcgagacttcatctctactaaaaattaacaacaaaaaagttggctgggtgtggtggtgtgcacctgttgtcccagctactcaggagactgaagtgggagaatcacttcagcccaggagatcaaggctgcagtgagctgtggtcatgccactgcactccagcctaggtgacacagtgagaccctgtgtccaaaaaaaaaattaactttttatatttagattttgtatttttatatcttggtatatctatctgatcattataatgca

SEQ ID NO: 206085 - DNA, 601 bp, Human
attttatttactggcacataatctttttaacacaaaagaaacaaggcatgtttgtgcccctacaatcatgttttaagttagttagttcagggaaagacaggactagttggctttgtattattactctgttgtagtttgggagaaactgaaatgaaatcctgtgttattggcaaatcagccaaattgtactattgcctgtcaaaatgctttgcctgccatgtattctcattattagaattcaaatactgtacctccaaattatgtcactgaatcctaacttgccttcagagatgcagttttrtaaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatccc

SEQ ID NO: 206086 - DNA, 601 bp, Human
ttataaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatyccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaaga

SEQ ID NO: 206087 - DNA, 601 bp, Human
aatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcrtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattc

SEQ ID NO: 206088 - DNA, 601 bp, Human
atcaacataaaatgatcattgtttagtgcaaaggattgtggtgacatttccggtgaggtaaaatcttcacctggattccaaaaacattattaagatatggcaatgaagtaagaagtccttggttacttagccacaggtttcagtgatggtaaaaatcactggaaaaaaaaggatttgggtagatttccataggtgattaaagtaaataaactagtaaatagcaaaagaaatgagatgaagaaacattctaaatgataactttttctttctgaaaccaaaatgtgactaaatcagctcttgkgaggcagtggtactcaaacttgcacaggcgtgagtctccctggaagggttgctccagcagagagctagatgctaccctaaagtgtcttatttcataggtcttcaaggggctggaaaatgtacatttctagcaagttcccaagtgatgctgctggtggtccaggaaccatacttggagaaacatttcaggcattctttcttacatttcactgtgtacatagaagcaaactgaatagttaggaagtacacattcagcgtacttattttcatctatagaaagtaaagcctggccaggcgcggt

SEQ ID NO: 206089 - DNA, 601 bp, Human
gagaatctcttgaacccaggaggcagaggtggtggtgagtcgagatagcaccattgcactccagcctgggcaacaagagcgaaactcccatctcaaaaaaaaaaaaaaaaaagttaagcctaaaatcttggcttggctgatggagcatgtacagaaaaatgagagcactgtagggttcagacattttaaaaggttaaggaaccaaatccacaaggaaggttaacttcctttgaccctgagaaagctcttatgttaatcatgcctggttactttatcatcttgaacattgttctgtttttartcagcattattgtgagttcagggttactgctcctatatatcttacatcatggttagtcaatcggatttagcatgtggaagagtcaatagatgctcatagatcattctctgaaaattttttaccaagagcaacagtgggttaatcctttatttgccagacttgagtctaaataatttttggcactaaaaatcactttggccaaagatttatgtggacctacacaatcactgctcttattcagggttttggggtttgcatttacactacgtttttcaagcctttttttgtttttgtttttgt

SEQ ID NO: 206090 - DNA, 601 bp, Human; identical to SEQ ID NO: 206053

SEQ ID NO: 206091 - DNA, 601 bp, Human; identical to SEQ ID NO: 206054

SEQ ID NO: 206092 - DNA, 601 bp, Human; identical to SEQ ID NO: 206055

SEQ ID NO: 206093 - DNA, 601 bp, Human; identical to SEQ ID NO: 206056

SEQ ID NO: 206094 - DNA, 601 bp, Human; identical to SEQ ID NO: 206057

SEQ ID NO: 206095 - DNA, 601 bp, Human; identical to SEQ ID NO: 206058

SEQ ID NO: 206096 - DNA, 601 bp, Human; identical to SEQ ID NO: 206059

SEQ ID NO: 206097 - DNA, 601 bp, Human; identical to SEQ ID NO: 206060

SEQ ID NO: 206098 - DNA, 601 bp, Human; identical to SEQ ID NO: 206061

SEQ ID NO: 206099 - DNA, 601 bp, Human; identical to SEQ ID NO: 206062

SEQ ID NO: 206100 - DNA, 601 bp, Human; identical to SEQ ID NO: 206063

SEQ ID NO: 206101 - DNA, 601 bp, Human; identical to SEQ ID NO: 206064

SEQ ID NO: 206102 - DNA, 601 bp, Human; identical to SEQ ID NO: 206065

SEQ ID NO: 206103 - DNA, 601 bp, Human; identical to SEQ ID NO: 206066

SEQ ID NO: 206104 - DNA, 601 bp, Human; identical to SEQ ID NO: 206067

SEQ ID NO: 206105 - DNA, 601 bp, Human; identical to SEQ ID NO: 206068

SEQ ID NO: 206106 - DNA, 601 bp, Human; identical to SEQ ID NO: 206069

SEQ ID NO: 206107 - DNA, 601 bp, Human; identical to SEQ ID NO: 206070

SEQ ID NO: 206108 - DNA, 601 bp, Human; identical to SEQ ID NO: 206071

SEQ ID NO: 206109 - DNA, 601 bp, Human; identical to SEQ ID NO: 206072

SEQ ID NO: 206110 - DNA, 601 bp, Human; identical to SEQ ID NO: 206073

SEQ ID NO: 206111 - DNA, 601 bp, Human; identical to SEQ ID NO: 206074

SEQ ID NO: 206112 - DNA, 601 bp, Human; identical to SEQ ID NO: 206075

SEQ ID NO: 206113 - DNA, 601 bp, Human; identical to SEQ ID NO: 206076

SEQ ID NO: 206114 - DNA, 601 bp, Human; identical to SEQ ID NO: 206077

SEQ ID NO: 206115 - DNA, 601 bp, Human; identical to SEQ ID NO: 206078

SEQ ID NO: 206116 - DNA, 601 bp, Human; identical to SEQ ID NO: 206079

SEQ ID NO: 206117 - DNA, 601 bp, Human; identical to SEQ ID NO: 206080

SEQ ID NO: 206118 - DNA, 601 bp, Human; identical to SEQ ID NO: 206081

SEQ ID NO: 206119 - DNA, 601 bp, Human; identical to SEQ ID NO: 206082

SEQ ID NO: 206120 - DNA, 601 bp, Human; identical to SEQ ID NO: 206083

SEQ ID NO: 206121 - DNA, 601 bp, Human; identical to SEQ ID NO: 206084

SEQ ID NO: 206122 - DNA, 601 bp, Human; identical to SEQ ID NO: 206085

SEQ ID NO: 206123 - DNA, 601 bp, Human; identical to SEQ ID NO: 206086

SEQ ID NO: 206124 - DNA, 601 bp, Human; identical to SEQ ID NO: 206087

SEQ ID NO: 206125 - DNA, 601 bp, Human; identical to SEQ ID NO: 206088

SEQ ID NO: 206126 - DNA, 601 bp, Human; identical to SEQ ID NO: 206089

SEQ ID NO: 206127 - DNA, 601 bp, Human; identical to SEQ ID NO: 19963

SEQ ID NO: 206128 - DNA, 601 bp, Human; identical to SEQ ID NO: 19964

SEQ ID NO: 206129 - DNA, 601 bp, Human; identical to SEQ ID NO: 19965

SEQ ID NO: 206130 - DNA, 601 bp, Human; identical to SEQ ID NO: 19966

SEQ ID NO: 206131 - DNA, 601 bp, Human; identical to SEQ ID NO: 19967

SEQ ID NO: 206132 - DNA, 601 bp, Human
aaattattagaactaataaaccaccaagattgcaagatacaagataatcaattgtttttctatacattaacaaccaactatgtgaaataaaagtaagaaaaagttcaatttacaatagcatcaaaaacagtaaacatttatgaataaatttaacaaagtagtctgagacttgtacaatgaaactacaaaacattgtttaacattattaaagaagatctaaataggttgaaagacatttcatgttcatgaatcagaggacttaattttgttaaaatggcaataccccacaaattaatgtacmcgttcaacacaacccttatcaaaattctagctgatttctttgcagaaattgacaagctgtcaattctgcaaattcatatggaaatggaagggacccagaatagccaaaacaatcttgataaaaagaaaacaaagatggaggacttgcacttctcaatatcaaaattactacacagctatagtattcaagacaatgtgatatcggcataaggatagatatatagatcaatgaaatagacttgagagtccagaaataagcccttacacttatggccaattaatttttgacagaagcagcaag

SEQ ID NO: 206133 - DNA, 601 bp, Human
gcaagatacaagataatcaattgtttttctatacattaacaaccaactatgtgaaataaaagtaagaaaaagttcaatttacaatagcatcaaaaacagtaaacatttatgaataaatttaacaaagtagtctgagacttgtacaatgaaactacaaaacattgtttaacattattaaagaagatctaaataggttgaaagacatttcatgttcatgaatcagaggacttaattttgttaaaatggcaataccccacaaattaatgtacacgttcaacacaacccttatcaaaattctagstgatttctttgcagaaattgacaagctgtcaattctgcaaattcatatggaaatggaagggacccagaatagccaaaacaatcttgataaaaagaaaacaaagatggaggacttgcacttctcaatatcaaaattactacacagctatagtattcaagacaatgtgatatcggcataaggatagatatatagatcaatgaaatagacttgagagtccagaaataagcccttacacttatggccaattaatttttgacagaagcagcaagacagtttaacagagaaagaatagtcttttca

SEQ ID NO: 206134 - DNA, 601 bp, Human
agtagaaacaacctaaattccattaactgaggaatgaataaacaaaatatagtttatccatacaatgggatattttttggcatcaaaaaggaatgaatgccaagcgcggaggctcacacctgtaatcctagcactttgggaggttgagacgggcagatcacttgaggtcaggagtttgagaccaacctggccaacatggtgaaaccccatgtctacaaaaatacaaaaattagccgggcatgttggtgcacgcctgtaatcccagctgcttgggaggctaaggcaggagaatcacttgaayccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcagattagtaggtgagtagttgcctagcactaggagttggggaggggaaacaaggagtgaatgtta

SEQ ID NO: 206135 - DNA, 601 bp, Human
catgttggtgcacgcctgtaatcccagctgcttgggaggctaaggcaggagaatcacttgaacccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcagrttagtaggtgagtagttgcctagcactaggagttggggaggggaaacaaggagtgaatgttaatgggttcgaggtgtcctctggggatgagattatttcagaattgggttataatgatggttacacatacaactctgcaaatatattaaaatcttttgatagcatatttttaaggggtgaatttaatggtatgtaaatgtatctcagtaaagctttttggaagataataacacattacagagtgctcctctggaaatgggtggctgatgggctgtatccagcctctacaagtgtttgatg

SEQ ID NO: 206136 - DNA, 601 bp, Human
gcaggagaatcacttgaacccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcagattagtaggtgagtagttgcctagcactaggagttggggaggggraacaaggagtgaatgttaatgggttcgaggtgtcctctggggatgagattatttcagaattgggttataatgatggttacacatacaactctgcaaatatattaaaatcttttgatagcatatttttaaggggtgaatttaatggtatgtaaatgtatctcagtaaagctttttggaagataataacacattacagagtgctcctctggaaatgggtggctgatgggctgtatccagcctctacaagtgtttgatggatcattattgacttatgagtaaacagagatattcttcaggctt

SEQ ID NO: 206137 - DNA, 601 bp, Human
accagttttcacgagccatgtatgggtccctgtttcatcaaacacttgccataactgagcaatatcttcatttttcttaatttttctaagttgcaacagcatccctcaaccctgtagctccttcttcccctatgcccagccacccactgctgtcaaggggtgagaaatcccacaccaagaacacaattgccccacctcaaaactgtcttagcttcatcccccttttcatcaaaaacattccttgaaacagaataaagaaacaacaaacagccacacgtatgtgggtactgggtctgctacrgagggctcggctgatgggtggcactgggccactggacatgcatctcgaggacaggggccagccagcacggagggctgaaggagaaggagaagaaatcagactccacctcttgccattcaggagactcagcttggggttgattagacttaaaagttaaaggcaaaactgtaagacatttagactacaggtgattattcttccaggtctcaagctaaaaggatttttcaaacaagactcagaacatattaaacacaaaggaaaagattggtaagtttgcctccctcaagataaggacactct

SEQ ID NO: 206138 - DNA, 601 bp, Human
tgggtctgctacggagggctcggctgatgggtggcactgggccactggacatgcatctcgaggacaggggccagccagcacggagggctgaaggagaaggagaagaaatcagactccacctcttgccattcaggagactcagcttggggttgattagacttaaaagttaaaggcaaaactgtaagacatttagactacaggtgattattcttccaggtctcaagctaaaaggatttttcaaacaagactcagaacatattaaacacaaaggaaaagattggtaagtttgcctccctcaagrtaaggacactctgttcattgaaagacaccaggagagagtgaaggcaagtcatggagtgattgacgagaattattcctagtatgtgaaggacctacaaatctttaagaaggggagtgtcattcactagaaaatgggcaagaagtttgagtacttactgtacaaaatataagcagcaagtatacaaaaggtgttcaacttcattaggactcggggaaatcagaagatcacagtgaactgctgctactaccacacatatgcccccagatgggcaacacttcaacaactgacaacacctgagta

SEQ ID NO: 206139 - DNA, 601 bp, Human
ttcttccaggtctcaagctaaaaggatttttcaaacaagactcagaacatattaaacacaaaggaaaagattggtaagtttgcctccctcaagataaggacactctgttcattgaaagacaccaggagagagtgaaggcaagtcatggagtgattgacgagaattattcctagtatgtgaaggacctacaaatctttaagaaggggagtgtcattcactagaaaatgggcaagaagtttgagtacttactgtacaaaatataagcagcaagtatacaaaaggtgttcaacttcattaggamtcggggaaatcagaagatcacagtgaactgctgctactaccacacatatgcccccagatgggcaacacttcaacaactgacaacacctgagtattaaagaagatccagagggctgggaacactcatataccaccggcaggaggacaagttggtaagacctccgtggaaaacaatttagcaatatgtcataaaactgaagctacattataatctatgacccagaaatcctatagtgggatccaaatttgtgtgcatgtgcgcctggatactcacaacagcattactcatgatggccaaaaa

SEQ ID NO: 206140 - DNA, 601 bp, Human
tttccccttcttaaactgctactatttcttgccttctgggaatgcaccataatttacttagccattcccctattcactgacgttcagttcatttcccatttgtagatgtgtttgtttgttttgggtattgcagtacaaacaatgctgccagaaccaaccttgtacaaacatcttgatgtactggtgctttaattaatggcagatccatttccagaactcagattgctggaacaaatcagcattttttcatcttaagaaataccgacaaaaatcctttcacaaaattgtatcgtaatttgcrgtcctaccagctgtgtatgaaaagatacttttgcccatccatacatttgtcagtacccgatgaccttgtttgacagtctaaaaatccctaagaccttgtggttgttttagtctgcactcccctgaccactaataagcatcactgcattgcctatttataagctttttttccctattgttctttcaattattaatctaaaggagctctttctatatcaggatagtatccgtttgttacatatgtatagcatttattatttgtcttctgttgcttttgccacaggagattttagttctttat

SEQ ID NO: 206141 - DNA, 601 bp, Human
atgaccttgtttgacagtctaaaaatccctaagaccttgtggttgttttagtctgcactcccctgaccactaataagcatcactgcattgcctatttataagctttttttccctattgttctttcaattattaatctaaaggagctctttctatatcaggatagtatccgtttgttacatatgtatagcatttattatttgtcttctgttgcttttgccacaggagattttagttctttattttattaactatgtattgtttacatctataacttttgggtttcctcctttgcttaagaaraccctttccatcccagtgttacacaaatacttcccccgtaattttgtctaatacttttataatttcccctttgagtttagagctttcattcatctacctttttttttttttttgagacagagtcttgctctgtttcctaggctggagtgcagtggcatgatcatggttcactgctgcctcaaactaacccaggctcaatccatcttcccacgtcagcctcccaagtagctggggctacaggcgtgcgccaccatgccccactcctgccacgtgttttcatacatacctgggtggaactct

SEQ ID NO: 206142 - DNA, 601 bp, Human
tattgttctttcaattattaatctaaaggagctctttctatatcaggatagtatccgtttgttacatatgtatagcatttattatttgtcttctgttgcttttgccacaggagattttagttctttattttattaactatgtattgtttacatctataacttttgggtttcctcctttgcttaagaaaaccctttccatcccagtgttacacaaatacttcccccgtaattttgtctaatacttttataatttcccctttgagtttagagctttcattcatctacctttttttttttttttgagacagagtcttgctctgtttcctaggctggagtgcagtggcatgatcatggttcactgctgcctcaaactaacccaggctcaatccatcttcccacgtcagcctcccaagtagctggggctacaggcgtgcgccaccatgccccactcctgccacgtgttttcatacatacctgggtggaactctcccggtagcattcgttcctgacttggatgacagggatgatgtctttcctcctgacttggatgacagggatgatgatacccacggtacaagctggcataggatggcagtcatga

SEQ ID NO: 206143 - DNA, 601 bp, Human
atgacaatatgagaggcttagatgacgatctaaaaaaagtgtgtatacacttcagtcttcccattttcagaatgacagaggagaaatctaatgatagtttgtttcttttcctagagtttctatctccctccctcccccactttcttcctctctcgttcactctctgcatctctttccttctctctgtctctgtttctcctgtctcttggacattttaaaatgtattcagtatatacctaggtgtatctttttcctttttttttttcccccccacctaggacttgtcattgagaaaaatgaygagacaagtctcaatcattttaggaaatttatttgcgaaagttaaggacgcatgcccgggagacagcactatgcctttctctgaaggtgattttgagggctccaaatttaaagggaaaagggcgggatattgagaagtacacaattttcatgtaagagcagggcagggaaaaatagttattcatgcctttctctggctcagtgaatctgcattttttttaacataagatgacataaacaaatgaggcagaggaaaaatgcagggagtctgcattttacataagagaacatagataaagta

SEQ ID NO: 206144 - DNA, 601 bp, Human
gatctaaaaaaagtgtgtatacacttcagtcttcccattttcagaatgacagaggagaaatctaatgatagtttgtttcttttcctagagtttctatctccctccctcccccactttcttcctctctcgttcactctctgcatctctttccttctctctgtctctgtttctcctgtctcttggacattttaaaatgtattcagtatatacctaggtgtatctttttcctttttttttttcccccccacctaggacttgtcattgagaaaaatgacgagacaagtctcaatcattttaggaratttatttgcgaaagttaaggacgcatgcccgggagacagcactatgcctttctctgaaggtgattttgagggctccaaatttaaagggaaaagggcgggatattgagaagtacacaattttcatgtaagagcagggcagggaaaaatagttattcatgcctttctctggctcagtgaatctgcattttttttaacataagatgacataaacaaatgaggcagaggaaaaatgcagggagtctgcattttacataagagaacatagataaagtaaggcaggggaacaatcagatatgcat

SEQ ID NO: 206145 - DNA, 601 bp, Human
ggtggttggggtacagcttgcttttgtgcattttagggagacataagacatcagtcaatacatgtaagatggacagtggtttggttttggaaaggtgggacaacttgggggaggggagcttccaggtcataggcagattcaaagagtttctgattggcaactgcttaaaagaattattatctaaaaacttggaatgtctaggttaagataaggggttgtggaaacaaagttttttatcatgcagatgaagcctccaggtagcaggcttcaggtagaatcaattgtaaatgtttcttatcartcttaaagagtctgttctaatgggcttaacatctctgtgttgatgtgaatgctgatcagttgtgcctgaattccaagaggaggagagtacaatgaggcacgtttagccacccattcctatcatggcctgaactaatttttcaggttaactttggaatgcccttggccaaggggagggtccatcagtcagttcaggggcttagaattttatttttggtttatgtctctcatagtttcatttatggcttccatttctttgtagtttcaccctgtatttgggttacatgttcttctattttgc

SEQ ID NO: 206146 - DNA, 601 bp, Human
ctccttacatattttaaattcagcctaaaagtttctctgtacatagtgaactgtaacctaactggatgtgtaaacagactgtcacctactctcatagcaagtaaccaagtctcagccaatcacagcggccagacttcagccactcacagtggccagctgttcaaactgggctcaagtaaggcaaatgctgagccatcaccaatctggctgtttctgtacctcacttccattttctgtacatcacgttcctttttctgcccataaatcctatccaactatgagacagcatcaaagtcactckgagcctgctctggtttaggggctgccctattcttgaattgttctttgctcaattaaactgctaaatttaatttgtctaaagcttttcttttaatacaagagaccaaacatctcacagtgattattctctttgtctgtttctctattgaagtcttcattcagaaatcatgtttgtggttacagaaagtctttttacactccaattatactaactgcatccccttaggatctctctgtctgtctgtctctctctctctctctctctctctgtctctctgtctctcttgctttctctctctct

SEQ ID NO: 206147 - DNA, 601 bp, Human
gggaattttaaaaatcatgtcagtttggcgaaactattccaatcaatagaaaaagagggaatcctccctaactcattatatgaggccagcatcatcccgataccaaagcctggcagacacacaacaaacaaagagaattttagaccaatatccctgatgaacatcaatgcgaaaatcctcaataaaatactggcaaaccgaatccagcagtacatcagaaagcttatccaccatgatcaagtgggcttcatccctgggatggaaggctggttcaacatacgcaaatcaataaatgtaatcyagcatataaacagaaccaatgacaaaaaacacatgattatctcaatagatgcagaaaaggcctttgacaaaattcaacaaccattcatgctgaaaactctcaataaattaggtattgatgggatgtatctcaaaataataagagctatttatgacagacccacagccaatatcatactgaaggagcaaaaactggaagcattccctttgaaaactggcacaagacagggatgccctctctcaccactcctattcaacatagtgttggaagttctggccagggcaatcaggcaggagaagg

SEQ ID NO: 206148 - DNA, 601 bp, Human
atggatgaagctggaaaccattattctcagcaaactatcgcaaggacaaaaaaccaaacaccgcatgttctcactcataggtgggaattgaacaatgagaacacttggacacaggaaggggaacatcacacaccagggcctgtcatggggtggggagaggggggagggatagcattaggagatatacctaattaggagttaatgggtgcagcacaccaacatggcacatgtatacatatgtaacaatcctgcacgttgtgcacatgtatcctagaatttaaagtataataataaaaaaaaagacatacacggaaaaaaggaacacaaatccacaggaacagttggtggactgtgcctttttccgaagatgtctttaagggcatcaatatttaaaggagaacaggctggaaggaagaaagggagggcatggtcacgttactgaatccacatgttgcaaaagaaaaggagcaggtaggggaatagtcagttatgtattcctcttgcgcttagtacatcagcacttgataaggtgaacaccaagagctacctgtggaggttttcaccttttatctgtagctatcttcgtttcttgcatcactca

SEQ ID NO: 206149 - DNA, 601 bp, Human
ggtagggagtgggtgcggaggctcacgcctgtaatcccagtgttcggggattcccgagcgggaggatcgcttgagccggggaggtggaagctgcagtgatctgcgccactgaactcccgcctgggcggcagagtgagaccctgtttcaaaaggcaccaggggtgtagggaaggagcgatatcccccaggcaaggaaggctgcggaggggccaggccaggagagaagggccctgagctcagtggacgggcagggtgcctgtggaggaagggagggacgtagcagcaggaggaagggtgaggrcccaggctggggatcgggagaagtgatggcggaggaaagagaggccggaagaggagggggcctgctggcctggcactggaaagcaaagcgtgggtttgtatatgggaagaagaccacatcccctcttatcgtcatcccaactcagaaaccatttggccccaagtcaccaaagcactcataggaaccacttttcctgtgacacaagtaggattctcccacttttaacttcccaaatgctacccgaaagcctctgaaatccttggaaatttaaaaaataatccccttctattaactgatgcc

SEQ ID NO: 206150 - DNA, 601 bp, Human
ctccccgcctagagtgggttaaactcagtgcccactggcaggaaactgaaacttggctgaagtcaccgaggaggccttccccgttaaacctctggctggcgacagcttggtttcctcgccgctgcttctgagtaattctggcacgcagttcctcctagccacctgctgtacctggaagggggccagccctcctcagcaggctttgctcctgccctgcacagcacaactgtggcgtaaaaaatggaaaagctggtagcagaaggaaagagcagggagacagaggttaggtgaacctcaatgrcctcattaaagcaaattgagaaagagagtttccttcccagtgaggcgggacagtgcagaaatgcggcccgtcctgggagaagtaggggcgaggggtggggggctcaccgggcacatggccaacagctggtgcccagcctgggccacagtttggcacaggagaaagctgaagatgcaggagaaagctaggtcactgcccctaggccaggtgatcaaggtggctgttacctgcctgtgtggccttgaaaaagcctggtgccctctctggcttgcagggtccttctttttacaaaagcgggtc

SEQ ID NO: 206151 - DNA, 601 bp, Human
agcctggtgccctctctggcttgcagggtccttctttttacaaaagcgggtcttcgaagccctgaatattccagttatctgtaaggatatagaaatattttgcctctagatgacatgtaaatatgttcctcctaactccacttcttcctacatctgtggcttcttctgagaactaccagacccaccctgttttcagagtaaacctcctgttttgaggtcaaacagacccagctgggtaattggtgactcactcctggttcctccaaagaacaggggcaagggaccacccgggacctcaggygccccagcacaggacctctttctggggcaccctctggcactgggccatcttcaggccctacagggctctcggggcctgcgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccagtgcctggctgctggtcgtagccatggtgagaccacagcagc

SEQ ID NO: 206152 - DNA, 601 bp, Human
tgtaaggatatagaaatattttgcctctagatgacatgtaaatatgttcctcctaactccacttcttcctacatctgtggcttcttctgagaactaccagacccaccctgttttcagagtaaacctcctgttttgaggtcaaacagacccagctgggtaattggtgactcactcctggttcctccaaagaacaggggcaagggaccacccgggacctcaggtgccccagcacaggacctctttctggggcaccctctggcactgggccatcttcaggccctacagggctctcggggcctgsgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccagtgcctggctgctggtcgtagccatggtgagaccacagcagcctccctggaagcaagcacctgtgtaaaagcccctccttccccacaaggggctggatccaagtgaagaaggtaccagaag

SEQ ID NO: 206153 - DNA, 601 bp, Human
tcctccaaagaacaggggcaagggaccacccgggacctcaggtgccccagcacaggacctctttctggggcaccctctggcactgggccatcttcaggccctacagggctctcggggcctgcgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccrgtgcctggctgctggtcgtagccatggtgagaccacagcagcctccctggaagcaagcacctgtgtaaaagcccctccttccccacaaggggctggatccaagtgaagaaggtaccagaaggactggaagatgatgctggtattattcgacagctccagggtgctgtagcactgagcacctactgtatgcagcccatcacaaagccagccacactgcccaggctgtgccatggcaacttccagcagtacaccctctcggtcacctgcaggctccttgttcatcctgacacatgaggagaa

SEQ ID NO: 206154 - DNA, 601 bp, Human
cttctctgggtattccagtgcctggctgctggtcgtagccatggtgagaccacagcagcctccctggaagcaagcacctgtgtaaaagcccctccttccccacaaggggctggatccaagtgaagaaggtaccagaaggactggaagatgatgctggtattattcgacagctccagggtgctgtagcactgagcacctactgtatgcagcccatcacaaagccagccacactgcccaggctgtgccatggcaacttccagcagtacaccctctcggtcacctgcaggctccttgttcatcytgacacatgaggagaaaaagacagtactcacaaaggcctctagccttgtggccccaggaccctctcctgagcatcatggcctcctaggagacccagggtagccaggacaaaggagagaagcatttgctaagctaagaaaggatggaaggggattgctgttctgcctggatgcacccctagacctggcagggcaggcaggagagacccccagtgtctcttgcttatcctaggagttcccccctgtggttgctccagtttgctgccttcatgcatgttcacagggtgattcccctgagacaa

SEQ ID NO: 206155 - DNA, 601 bp, Human
tgactccccagctttccccatgacaaggtgtgtgtctacagctcagacccagccatgctccacctgagaagtgggtccaggcagagcactgggtcctggccacctagggctgcctcctcaggggtgggcaggaaggggagccactggaggagtgccccgggcacagtcccctgcaccaggtgaggtcacctcttagtccatgaggcgatgctgcatgagcccctctggacactagaaggcctgggctcaatgctgagtaaagtgcaggcatgactgtgccctcagcatgcatagggcagcrggcatagattcatacacgtgagtttgcacttaagctgcagtaagagctacagaggaaatgaacagagacagcatcactccagtgagccctccagatacaccccatgtgcgcagtaagagaatggcatagtctattgggacagccacatcaaaataccacagaccagatggcttaaacggcagatatttgtctctcacaggtccggaggctagaagtccaagattagggtgccagccaatccacttgctggtgagggccctcttcccagcttgcagatgtctctgtgttcccacagcatgg

SEQ ID NO: 206156 - DNA, 601 bp, Human
ggcgatgctgcatgagcccctctggacactagaaggcctgggctcaatgctgagtaaagtgcaggcatgactgtgccctcagcatgcatagggcagcaggcatagattcatacacgtgagtttgcacttaagctgcagtaagagctacagaggaaatgaacagagacagcatcactccagtgagccctccagatacaccccatgtgcgcagtaagagaatggcatagtctattgggacagccacatcaaaataccacagaccagatggcttaaacggcagatatttgtctctcacaggtcyggaggctagaagtccaagattagggtgccagccaatccacttgctggtgagggccctcttcccagcttgcagatgtctctgtgttcccacagcatggtcacgtggcagagagagggggacagggcatgaataagccctcggtgccttcctcttcttacgaggatgctaatcccatcacgggtaccccaccctcgtgacctcgtctaaccctaatcacctcccaaaggccccatctcctaatgccatcacactgggggtcagggcttcaacacatgaatttggggagcacaatttagtcca

SEQ ID NO: 206157 - DNA, 601 bp, Human; identical to SEQ ID NO: 19968

SEQ ID NO: 206158 - DNA, 601 bp, Human; identical to SEQ ID NO: 19969

SEQ ID NO: 206159 - DNA, 601 bp, Human; identical to SEQ ID NO: 19970

SEQ ID NO: 206160 - DNA, 601 bp, Human; identical to SEQ ID NO: 19971

SEQ ID NO: 206161 - DNA, 601 bp, Human; identical to SEQ ID NO: 19972

SEQ ID NO: 206162 - DNA, 601 bp, Human
gagtcgcaggaaagggagaggggtgcccagaggtcatcactctttccccaggcctgatttttggtccatctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctcygcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgagg

SEQ ID NO: 206163 - DNA, 601 bp, Human
gcaccagccacatgccaaggctatcctatgggttaacctgcacagtccgcaatcccttaccctcgattctaaatctaaaaaatctgaaaactgctgcatatttcaaaactgtgcagcaaattcattgtttgtaaacaaaccttctttgaagcaataggtgaggttatttagaggctttttccattcaatgtgatatgtatgtggatcactgcagaaatactgctctgttcgattgtaaaatagtatgttgccctagactgggggtgggagggggtatggcacataatgaagtatacccacwgctaaaatcctaaaaattctggattctgaagcacatttgaccactggggttttagataacctatctttatttgtgtaatcatcaccacaaccatcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactga

SEQ ID NO: 206164 - DNA, 601 bp, Human
gatatttcaatatcaagagagctaccaccataatttattatacccataaggataaagtttatgattatatcaattcacactaaaagggaatttaataacatttaatagccacaactaataaaaattaataggaggaaccttactttatatgataaagatagctaacatcaaaaaggtgcaactctaatgccatttccattaaaataataagaatgctgatatcactgtttttattcaacattattttagaggtcataccacatgataaaacaggaaaacaatcaataaacatattgtcaargaacagggaagatgatcttttctggtaatgctatggtagacctagaaaacacaagagattctaatttttttaaaagctactagattaataaattcatttggcaaagtgtttagataaatatatttctcaaaaaaatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgc

SEQ ID NO: 206165 - DNA, 601 bp, Human
cacaactaataaaaattaataggaggaaccttactttatatgataaagatagctaacatcaaaaaggtgcaactctaatgccatttccattaaaataataagaatgctgatatcactgtttttattcaacattattttagaggtcataccacatgataaaacaggaaaacaatcaataaacatattgtcaaagaacagggaagatgatcttttctggtaatgctatggtagacctagaaaacacaagagattctaatttttttaaaagctactagattaataaattcatttggcaaagtgyttagataaatatatttctcaaaaaaatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgcaacctccacctcccaggttcaagcaattctcctgcctcagcctcccgagtagctgggattacaggcacctgccaccacgcccagctaattttttgtatttttagtagag

SEQ ID NO: 206166 - DNA, 601 bp, Human
gcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattggggaggaaactgtaaaaatgtcagttctaccaaattctattataaaaacttaatgcacttccaagtaaaatttcagccagaattttttatctttcttggtgsgggtgtggtggtggtgaagaggaactaaaaaggagagaaaacaattaaaaaattgaaagattcatatggaaaaagaaatctagcatagtcaaaaattttttgaaaaaaattaaaaccacatagagaggcagggcaaccaagtgagacctcatgtcttaaaaaaaaaaaaaattaatagaaaaaattaggtatggtggcgcatgcctgtaatcccaactgctcaggaggctgaggtgggaggatggcttgagtccaggagtttgaggctgcagtgagccatggtcgctccactgcactcca

SEQ ID NO: 206167 - DNA, 601 bp, Human
caccagcaaggacggagccccatgctctgctcatgagttgttgcagcctggcagtgttcacgggataactggtgggcctgggcagcccaaggtcagagcttcggccagcaccggagcaaggtcagagcttcggccagcaccggagcagatcccacagcgcctgctgtaccaggtgcatgttgcagtgggcggtcagagggtcctggggttgaggctgtcgtggcgaggacagttgtgttaccgagctggactgggatctgcttgcccagtgcagcaaaaccaaacactgagattgggatakaatctacgagaacacaaggcatttattgcggggaccaaaaaaggagaattgggcagctcactcttaagaccggaactccctgatggcttgcaggtaagggtttttaaaggcagagtgaatttcaggaattgcagaagttaacaggcaaaatcattaatcaatacatggagggtacacattggttttggcctaaaagggcgggatatcttgaagtgggggtgggcttccaggtcataggtagattcaaaaatttgttgttttgaaattggttaaggaagagaagtttcatttaaaaatttg

SEQ ID NO: 206168 - DNA, 601 bp, Human
aaggacggagccccatgctctgctcatgagttgttgcagcctggcagtgttcacgggataactggtgggcctgggcagcccaaggtcagagcttcggccagcaccggagcaaggtcagagcttcggccagcaccggagcagatcccacagcgcctgctgtaccaggtgcatgttgcagtgggcggtcagagggtcctggggttgaggctgtcgtggcgaggacagttgtgttaccgagctggactgggatctgcttgcccagtgcagcaaaaccaaacactgagattgggatataatctasgagaacacaaggcatttattgcggggaccaaaaaaggagaattgggcagctcactcttaagaccggaactccctgatggcttgcaggtaagggtttttaaaggcagagtgaatttcaggaattgcagaagttaacaggcaaaatcattaatcaatacatggagggtacacattggttttggcctaaaagggcgggatatcttgaagtgggggtgggcttccaggtcataggtagattcaaaaatttgttgttttgaaattggttaaggaagagaagtttcatttaaaaatttgggttacc

SEQ ID NO: 206169 - DNA, 601 bp, Human
gttctgacagccagtagcactgaacaggtgtgcaccaggagagtgaaactgtctgaggaacagtagggcaggcactgtctactcgaaaacatacccaaacccccaaggctcagccttcgctagcagccactcagcagaaatgaaagcacaaatgtgtgtgggtagcaacaggagcatagtttgtgatggggaaaaaaattgaaaacagtctgaaggcagaagaggattgagtgagtgagcccttccatgtcctcaccataaaatgttgaggcgtctttgaaaggaatgctttggttccctyccagctgacctggaggggtctccacaatgagttaacagtggaaaaacaagacacaagggaccgataaaggatacatatctgtcgtatacaaatagctccttcaaactgctaaggcaatgggcatggtctcacttatgtaaaatgaatgcaaggatgcagcaggcctactgtgccagcatggggacacaaggacgcagtgtcaccaggtaggaacacagtgatggcccagtgggggacaggtgagcaaaacaaagagacagatgttgattataatcatattcagttgatggaaaattggac

SEQ ID NO: 206170 - DNA, 601 bp, Human
caagttctggcatcccatggcaggccaaaatcctggacaggagtgggaggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataaygctggggttaggcttctattgaacccatcactcaaatactgagcatagtacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtatt

SEQ ID NO: 206171 - DNA, 601 bp, Human
caggccaaaatcctggacaggagtgggaggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataatgctggggttaggcttctatygaacccatcactcaaatactgagcatagtacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcac

SEQ ID NO: 206172 - DNA, 601 bp, Human
ggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataatgctggggttaggcttctattgaacccatcactcaaatactgagcatartacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcacattttctttatctggtgccactattgat

SEQ ID NO: 206173 - DNA, 601 bp, Human
tgcaataaacatatgtgtgcctatgtccttttggtaaaacaatttcttttcctttgggtaggtacacagtaatggggttgttgggtcaactggtaattctatttgcagttctttgcaaaatctccaaactgctttccacagggatggaagtaatttacactgccaccaacagtgtgtaagcattcccttttgtctgcatcctgccaacatctgtcatttttttactttttaataatagccattctgactggtatccctttgtggttttaatttgcatttctctgatgattagtgatgttgrgcattttttcatatgtttgttggccacttgtatgtcttcttttgagaagtgtctgttcctgtcctttgcccactttttaatggtggtgttttttcttaagttcctcatagattctgggtattagtcgtttgtggatgcatagttgcaaatattttctctcattctgtaggttgtctgtttactttgttgatagtttgttttgctgtgcagaagctctttaatttgattaagtctcatttgtcaatttttgtttttgttgcatatgcctttgaggtctagtcataaattctttgcctagga

SEQ ID NO: 206174 - DNA, 601 bp, Human
ttagtcgtttgtggatgcatagttgcaaatattttctctcattctgtaggttgtctgtttactttgttgatagtttgttttgctgtgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagygtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccat

SEQ ID NO: 206175 - DNA, 601 bp, Human
tttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcakttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattag

SEQ ID NO: 206176 - DNA, 601 bp, Human
cttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgygttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggagg

SEQ ID NO: 206177 - DNA, 601 bp, Human
catatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatayctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctg

SEQ ID NO: 206178 - DNA, 601 bp, Human
tctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctscctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcatttcacctgtttccttttattttt

SEQ ID NO: 206179 - DNA, 601 bp, Human
tcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctccctcccccctccttggtcctcagggagtgctgaggcttctrgggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcatttcacctgtttccttttatttttattaatatggcttcctgaatatatacaattccatgtgtggg

SEQ ID NO: 206180 - DNA, 601 bp, Human
atttttatgtgaaactgtctggtatttaaaagcagccaactaatctcaagtataaacagacaggcacgcctaatgtgcaagtcacactctgctctccctcctccctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaakagttttagattggtttcatgttgaagtgataatattctggatatattgggtaaaataaaattatattattcaccggcatttcacctgtttccttttatttttattaatatggcttcctgaatatatacaattccatgtgtggggtagcattatatgtctattggacagcactgttttcgagggagagacgcccaaggaccccaccttccacaatacttatagcaagtgacacagctgtgtgctctgggacagttctccctccccagccatgaccactgtgctgcagtgacactggtcttt

SEQ ID NO: 206181 - DNA, 601 bp, Human; identical to SEQ ID NO: 19973

SEQ ID NO: 206182 - DNA, 601 bp, Human; identical to SEQ ID NO: 19974

SEQ ID NO: 206183 - DNA, 601 bp, Human; identical to SEQ ID NO: 19975

SEQ ID NO: 206184 - DNA, 601 bp, Human; identical to SEQ ID NO: 19976

SEQ ID NO: 206185 - DNA, 601 bp, Human; identical to SEQ ID NO: 19977

SEQ ID NO: 206186 - DNA, 601 bp, Human; identical to SEQ ID NO: 19978

SEQ ID NO: 206187 - DNA, 601 bp, Human; identical to SEQ ID NO: 19979

SEQ ID NO: 206188 - DNA, 601 bp, Human; identical to SEQ ID NO: 19980

SEQ ID NO: 206189 - DNA, 601 bp, Human; identical to SEQ ID NO: 19981

SEQ ID NO: 206190 - DNA, 601 bp, Human; identical to SEQ ID NO: 25055

SEQ ID NO: 206191 - DNA, 601 bp, Human; identical to SEQ ID NO: 25056

SEQ ID NO: 206192 - DNA, 601 bp, Human; identical to SEQ ID NO: 25057

SEQ ID NO: 206193 - DNA, 601 bp, Human; identical to SEQ ID NO: 25058

SEQ ID NO: 206194 - DNA, 601 bp, Human; identical to SEQ ID NO: 25059

SEQ ID NO: 206195 - DNA, 601 bp, Human; identical to SEQ ID NO: 25060

SEQ ID NO: 206196 - DNA, 601 bp, Human; identical to SEQ ID NO: 25061

SEQ ID NO: 206197 - DNA, 601 bp, Human; identical to SEQ ID NO: 25062

SEQ ID NO: 206198 - DNA, 601 bp, Human; identical to SEQ ID NO: 25063

SEQ ID NO: 206199 - DNA, 601 bp, Human; identical to SEQ ID NO: 25064

SEQ ID NO: 206200 - DNA, 601 bp, Human; identical to SEQ ID NO: 25065

SEQ ID NO: 206201 - DNA, 601 bp, Human; identical to SEQ ID NO: 25066

SEQ ID NO: 206202 - DNA, 601 bp, Human; identical to SEQ ID NO: 25067

SEQ ID NO: 206203 - DNA, 601 bp, Human
ggagggcacggccggttgggctcctatcccacaaatcttccagtgggaaatggacagataccattctgctagggcacatccaggagggggctaagtgccaagcccccactccccatccccagaagctggcccgagttcccactcccacggtccccaggcaccctagagagggcagaggcagaccgggcgccatgactcatgcctataatcccagcacttgagggagaccaaggcaggaggatcacttgaggccaggagactgagaccagcctgggcaacacagcaagaccccatctctacaaaaaaaaacttaaaaattagctgggctggtggtgcgcgcctgtaatcccactacttcgggaggctaaggagggagtagggcttgagcctgggaggtcgaggctgcagtgagctgtgagggcgccactgcactcaagcctgggaaacacagcgagaccccatctcaaaaagggcgagacggggtggggcagagacgacgccagcaggcctcggggaatgggtcgggggggagtggggtgcaggcggggctggatccagcatcctcgccccaggggtccccgcccgcggcggcggaccacgg

SEQ ID NO: 206204 - DNA, 601 bp, Human
gctggttcccgtccagtctccactgctcttcttctaagctcagccggagggcacggccggttgggctcctatcccacaaatcttccagtgggaaatggacagataccattctgctagggcacatccaggagggggctaagtgccaagcccccactccccatccccagaagctggcccgagttcccactcccacggtccccaggcaccctagagagggcagaggcagaccgggcgccatgactcatgcctataatcccagcacttgagggagaccaaggcaggaggatcacttgaggccagragactgagaccagcctgggcaacacagcaagaccccatctctacaaaaaaaaacttaaaaattagctgggctggtggtgcgcgcctgtaatcccactacttcgggaggctaaggagggagtagggcttgagcctgggaggtcgaggctgcagtgagctgtgagggcgccactgcactcaagcctgggaaacacagcgagaccccatctcaaaaagggcgagacggggtggggcagagacgacgccagcaggcctcggggaatgggtcgggggggagtggggtgcaggcggggctggatcc

SEQ ID NO: 206205 - DNA, 601 bp, Human
agaccagcctgggcaagagagtgagagcctttctaaaaaaacagaaaagtaaaaagagactcatggctggttcccgtccagtctccactgctcttcttctaagctcagccggagggcacggccggttgggctcctatcccacaaatcttccagtgggaaatggacagataccattctgctagggcacatccaggagggggctaagtgccaagcccccactccccatccccagaagctggcccgagttcccactcccacggtccccaggcaccctagagagggcagaggcagaccgggcgcsatgactcatgcctataatcccagcacttgagggagaccaaggcaggaggatcacttgaggccaggagactgagaccagcctgggcaacacagcaagaccccatctctacaaaaaaaaacttaaaaattagctgggctggtggtgcgcgcctgtaatcccactacttcgggaggctaaggagggagtagggcttgagcctgggaggtcgaggctgcagtgagctgtgagggcgccactgcactcaagcctgggaaacacagcgagaccccatctcaaaaagggcgagacggggtggggcag

SEQ ID NO: 206206 - DNA, 601 bp, Human
tgagaccagcctgggcaagagagtgagagcctttctaaaaaaacagaaaagtaaaaagagactcatggctggttcccgtccagtctccactgctcttcttctaagctcagccggagggcacggccggttgggctcctatcccacaaatcttccagtgggaaatggacagataccattctgctagggcacatccaggagggggctaagtgccaagcccccactccccatccccagaagctggcccgagttcccactcccacggtccccaggcaccctagagagggcagaggcagaccgggcsccatgactcatgcctataatcccagcacttgagggagaccaaggcaggaggatcacttgaggccaggagactgagaccagcctgggcaacacagcaagaccccatctctacaaaaaaaaacttaaaaattagctgggctggtggtgcgcgcctgtaatcccactacttcgggaggctaaggagggagtagggcttgagcctgggaggtcgaggctgcagtgagctgtgagggcgccactgcactcaagcctgggaaacacagcgagaccccatctcaaaaagggcgagacggggtggggc

SEQ ID NO: 206207 - DNA, 601 bp, Human
gcacaggtgaataggattggcacagaattgatgactgctttagttgggctgtaggtactttacagtcaatctactattttctctacttttgtgtacatttgaagttttcgtattagaaagtgtggctcacacctgtaatctcagcactttgggaggcccaggtgggaggatggcttgagaccagcctgggcaagagagtgagagcctttctaaaaaaacagaaaagtaaaaagagactcatggctggttcccgtccagtctccactgctcttcttctaagctcagccggagggcacggccrgttgggctcctatcccacaaatcttccagtgggaaatggacagataccattctgctagggcacatccaggagggggctaagtgccaagcccccactccccatccccagaagctggcccgagttcccactcccacggtccccaggcaccctagagagggcagaggcagaccgggcgccatgactcatgcctataatcccagcacttgagggagaccaaggcaggaggatcacttgaggccaggagactgagaccagcctgggcaacacagcaagaccccatctctacaaaaaaaaacttaa

SEQ ID NO: 206208 - DNA, 601 bp, Human
agtcacacaaaacaattatgccacaatggaggaattctgaacactggatatctggtgataatgagctattactaatgtttaggtttgctaatggtactgcagttgtgtttttacatggaggcctcatcttttagccactcatatacatcctaaaacgtttcctaatccaactacacaaagttggatttgcttggagaccatggggagggcacaggtgaataggattggcacagaattgatgactgctttagttgggctgtaggtactttacagtcaatctactattttctctacttttgtrtacatttgaagttttcgtattagaaagtgtggctcacacctgtaatctcagcactttgggaggcccaggtgggaggatggcttgagaccagcctgggcaagagagtgagagcctttctaaaaaaacagaaaagtaaaaagagactcatggctggttcccgtccagtctccactgctcttcttctaagctcagccggagggcacggccggttgggctcctatcccacaaatcttccagtgggaaatggacagataccattctgctagggcacatccaggagggggctaagtgccaagcccc

SEQ ID NO: 206209 - DNA, 601 bp, Human
gaggtcttgctgtgttgcccaggttggtctcaaacttctggcctcaagtgatcctcctgcctcagcttcccaaagtgcagggattacaggcacgagccatcacacctggccgacttctacagcttctttcacaaatatggcaaagagaaaaaaggaagcaagagacaggagaatctggagattcattgcaatgcatgtcgagtcacacaaaacaattatgccacaatggaggaattctgaacactggatatctggtgataatgagctattactaatgtttaggtttgctaatggtactgcrgttgtgtttttacatggaggcctcatcttttagccactcatatacatcctaaaacgtttcctaatccaactacacaaagttggatttgcttggagaccatggggagggcacaggtgaataggattggcacagaattgatgactgctttagttgggctgtaggtactttacagtcaatctactattttctctacttttgtgtacatttgaagttttcgtattagaaagtgtggctcacacctgtaatctcagcactttgggaggcccaggtgggaggatggcttgagaccagcctgggcaa

SEQ ID NO: 206210 - DNA, 601 bp, Human
tattcactgccagggtctgggacaggaaggggagagagtggctacaaaagagcaacatgaagggtccttctctgatggaaaggctctgtatcgtgactgtatcgacgtcaatatcctggttgtaagattgtgctatctagttctacagaacataatcactgagggaaagctggcagagggtatgtgggatctctactatttcttacaactgcataggactccagaattatctcaaaatcaaaagtttaatttttaaaaaaggcatgtttagttcctagctctgccatctgctaattaggtwgctgactttgaacagattttaatgtctctatcctcaatttcctcattcactaaatgaggtaataccatctgaagcattatgaaaattcaacaccatatttgaaaggatcaggcacgatgtgtacagcacacagtccgtgctctagaaggagcctgtcaacactaaccctctatatagccacaagtattattctaaatggtatcattcaaatgtccagtactaaaggcactgcagagcaatttatttaaagtcccttccctggccaagtttagtatttcacacatgtaatcccagcacttt

SEQ ID NO: 206211 - DNA, 601 bp, Human
ttgaggactcttaactgacagaactactgaacaatcagcaagcatatagaactcaacaccactatcaatcaagatctgacacatgtagaacattccgccaaacgagcatacgcgtttatcatgtacttacaggatgttcaccaacaaaagaccacagaacatctgccaaatagaccgtatcctaggccagaaaacaaaccaacacatttaaaagaagtgaaaccatacacagtatactctctgtccatagtggagtcgaaccagaaatcaacaaaagagagacaacaggaaaatcttttcttttttttttgaggcaggatcttactctgtcgcccaggataaagtgcagtggcacgatgttggctcactgcaacctttgcctcccaggttcaagtgatcctcccacccgcctcccaggttcaagtgtgcaccaccacacccggctaatttgtttgtttttgaaatggagtcttgctctgtcgcccaggctggagtacagtggcgtgctctctgtgcactgcaacctatgcctcctaggttcaagtgattctcctgcctcagcctactgagtagctgggattacaggcacctgctactgcac

SEQ ID NO: 206212 - DNA, 601 bp, Human
taatcctaaacatttatgcaccacacaacaggacctcaaaatacaggaaacaaaaactgatagagctaaagaagaaatagacaaatccacaattatagttgaggactcttaactgacagaactactgaacaatcagcaagcatatagaactcaacaccactatcaatcaagatctgacacatgtagaacattccgccaaacgagcatacgcgtttatcatgtacttacaggatgttcaccaacaaaagaccacagaacatctgccaaatagaccgtatcctaggccagaaaacaaaccaayacatttaaaagaagtgaaaccatacacagtatactctctgtccatagtggagtcgaaccagaaatcaacaaaagagagacaacaggaaaatcttttcttttttttttgaggcaggatcttactctgtcgcccaggataaagtgcagtggcacgatgttggctcactgcaacctttgcctcccaggttcaagtgatcctcccacccgcctcccaggttcaagtgtgcaccaccacacccggctaatttgtttgtttttgaaatggagtcttgctctgtcgcccaggctggagtacagtggc

SEQ ID NO: 206213 - DNA, 601 bp, Human
acttcaaagaaaattactggagaaaaaagaaggacattacataataaaaaaggttaatctatcaagatataataatcctaaacatttatgcaccacacaacaggacctcaaaatacaggaaacaaaaactgatagagctaaagaagaaatagacaaatccacaattatagttgaggactcttaactgacagaactactgaacaatcagcaagcatatagaactcaacaccactatcaatcaagatctgacacatgtagaacattccgccaaacgagcatacgcgtttatcatgtacttacrggatgttcaccaacaaaagaccacagaacatctgccaaatagaccgtatcctaggccagaaaacaaaccaacacatttaaaagaagtgaaaccatacacagtatactctctgtccatagtggagtcgaaccagaaatcaacaaaagagagacaacaggaaaatcttttcttttttttttgaggcaggatcttactctgtcgcccaggataaagtgcagtggcacgatgttggctcactgcaacctttgcctcccaggttcaagtgatcctcccacccgcctcccaggttcaagtgtgcac

SEQ ID NO: 206214 - DNA, 601 bp, Human
cttgtctctaagatagtaacagtcataataatgactttaccctaaatgtaaagagtggattaaaaaatatgatgcaacaatatgctgtctatatgaaactcacttcaaaacaagggtattaaaagaatggagaaatatatattatgaaagcattaataaaaacataagtggctatattaaaatatctgataatggagacttcaaagaaaattactggagaaaaaagaaggacattacataataaaaaaggttaatctatcaagatataataatcctaaacatttatgcaccacacaacagracctcaaaatacaggaaacaaaaactgatagagctaaagaagaaatagacaaatccacaattatagttgaggactcttaactgacagaactactgaacaatcagcaagcatatagaactcaacaccactatcaatcaagatctgacacatgtagaacattccgccaaacgagcatacgcgtttatcatgtacttacaggatgttcaccaacaaaagaccacagaacatctgccaaatagaccgtatcctaggccagaaaacaaaccaacacatttaaaagaagtgaaaccatacacagta

SEQ ID NO: 206215 - DNA, 601 bp, Human
cagttcatgcctgtaatctcggcactttggccaggagactgggataagttacatatgtatactgtaaacctaggggaactaccaagaaaataatacaaagcattatacttaaaaaaaaaaaaaaaaatcagccagggaggatcgctcatgcctataatctcggcactttggctgaggcaggaggatggctttgaggctagcaattcaagagcagcctaagtaacatagtggaaccctatctacaaaaaataaatatagattaaaaattagctgggtgtggtggtgcacatctgtagtcccrgctactagggaggctgaggtgggaggatggtttgggtccaggaggtcaagactacagtgagccatgatcgtgccactgcgcttcagcctaggcaatagcaaaagaccttgtctctaagatagtaacagtcataataatgactttaccctaaatgtaaagagtggattaaaaaatatgatgcaacaatatgctgtctatatgaaactcacttcaaaacaagggtattaaaagaatggagaaatatatattatgaaagcattaataaaaacataagtggctatattaaaatatctgataatg

SEQ ID NO: 206216 - DNA, 601 bp, Human
acatgtatactgcaaacctaaggcaactaccaagaaaataatacaaagcattatacttaaaaaaaaaaatcaatcagccagggaggacagttcatgcctgtaatctcggcactttggccaggagactgggataagttacatatgtatactgtaaacctaggggaactaccaagaaaataatacaaagcattatacttaaaaaaaaaaaaaaaaatcagccagggaggatcgctcatgcctataatctcggcactttggctgaggcaggaggatggctttgaggctagcaattcaagagcascctaagtaacatagtggaaccctatctacaaaaaataaatatagattaaaaattagctgggtgtggtggtgcacatctgtagtcccagctactagggaggctgaggtgggaggatggtttgggtccaggaggtcaagactacagtgagccatgatcgtgccactgcgcttcagcctaggcaatagcaaaagaccttgtctctaagatagtaacagtcataataatgactttaccctaaatgtaaagagtggattaaaaaatatgatgcaacaatatgctgtctatatgaaactcacttca

SEQ ID NO: 206217 - DNA, 601 bp, Human
ccttcagacagctaacattttatccacttctaactggatgtgaaatttagtaatgaaaacgctcttgggatttaacgcatcacacataagtcagggaatggaagcactgtgagataaatctaagctggcctgatgtcttccaacagcctgaggcacaccccaccaccagaggcattattacacaacttcgggaacaccaaatacacaaactttaaggacagcccagtcaggaagtgacgagatatcatctgtagaattagaaaaataaaaagaataaactaggctgttccccacacccccrttgatgttggcccacgggggttgccggtccctttaactggcatgtaccaagtccttccaggtgacatttcctccctgtgtcccagcttttagggatcattggccatgggtccaaggggagggaatgtggagacagggttgtatttgccagggaattctgggccgacagggagcaagagcgcgcttgggggcaaagtcccattgtctcatgctgttctccagtcccgagatggtggccaccatgaagaagacggctgcagaagatgtcaatgttactttcgaagagcaacaaaagataaac

SEQ ID NO: 206218 - DNA, 601 bp, Human
ctggcttccaaatctcacatgacagatgactgaaggtcaaaccctgctccccctaattattttgttaagataatcaacatgtaaactcgaaagccaggggacaagaccaatcactcatgtgttctgaatccccaaaaatggccagaggagtctctctggatttagttagctgagggaaaaagatgtttttgcatttgttttgttttgttttttggtattacgaaaggaccaaccccgtatgtcaaagcataaggtaaacctgttaaatgcaatttgccaacaaggccataaaaaccaaactgcttccagaccccagaagcagatgtatgcttctgccgccacgcaaacccgccgcagcatcaagcctaaagaggcacttctgaactcccaagacagagactcttaaaggccagaacagcagaggaggctgcttcaaagttccgtacgtcctggcaaaaagtacatgtgatacagcaaacaattcttcaaaaaaaaaatttaatttccaaaatttttacataatctttgatattccacaacaaaagctgttaacctgcagtgcatgggccactggtaggcccactcttgggattccggatgt

SEQ ID NO: 206219 - DNA, 601 bp, Human
ccatgaacccactctcaactgagtaagaacagaaaataattacgagctgtcaacggaacactatctcacatcaagcacagctggcttccaaatctcacatgacagatgactgaaggtcaaaccctgctccccctaattattttgttaagataatcaacatgtaaactcgaaagccaggggacaagaccaatcactcatgtgttctgaatccccaaaaatggccagaggagtctctctggatttagttagctgagggaaaaagatgtttttgcatttgttttgttttgttttttggtattaygaaaggaccaaccccgtatgtcaaagcataaggtaaacctgttaaatgcaatttgccaacaaggccataaaaaccaaactgcttccagaccccagaagcagatgtatgcttctgccgccacgcaaacccgccgcagcatcaagcctaaagaggcacttctgaactcccaagacagagactcttaaaggccagaacagcagaggaggctgcttcaaagttccgtacgtcctggcaaaaagtacatgtgatacagcaaacaattcttcaaaaaaaaaatttaatttccaaaatttttacata

SEQ ID NO: 206220 - DNA, 601 bp, Human
taaaaccggtacgatccatgaacccactctcaactgagtaagaacagaaaataattacgagctgtcaacggaacactatctcacatcaagcacagctggcttccaaatctcacatgacagatgactgaaggtcaaaccctgctccccctaattattttgttaagataatcaacatgtaaactcgaaagccaggggacaagaccaatcactcatgtgttctgaatccccaaaaatggccagaggagtctctctggatttagttagctgagggaaaaagatgtttttgcatttgttttgtttkgttttttggtattacgaaaggaccaaccccgtatgtcaaagcataaggtaaacctgttaaatgcaatttgccaacaaggccataaaaaccaaactgcttccagaccccagaagcagatgtatgcttctgccgccacgcaaacccgccgcagcatcaagcctaaagaggcacttctgaactcccaagacagagactcttaaaggccagaacagcagaggaggctgcttcaaagttccgtacgtcctggcaaaaagtacatgtgatacagcaaacaattcttcaaaaaaaaaatttaatttc

SEQ ID NO: 206221 - DNA, 601 bp, Human
ataaggccgaagtttaaatcttcagttccatttaaaaccggtacgatccatgaacccactctcaactgagtaagaacagaaaataattacgagctgtcaacggaacactatctcacatcaagcacagctggcttccaaatctcacatgacagatgactgaaggtcaaaccctgctccccctaattattttgttaagataatcaacatgtaaactcgaaagccaggggacaagaccaatcactcatgtgttctgaatccccaaaaatggccagaggagtctctctggatttagttagctgasggaaaaagatgtttttgcatttgttttgttttgttttttggtattacgaaaggaccaaccccgtatgtcaaagcataaggtaaacctgttaaatgcaatttgccaacaaggccataaaaaccaaactgcttccagaccccagaagcagatgtatgcttctgccgccacgcaaacccgccgcagcatcaagcctaaagaggcacttctgaactcccaagacagagactcttaaaggccagaacagcagaggaggctgcttcaaagttccgtacgtcctggcaaaaagtacatgtgatacag

SEQ ID NO: 206222 - DNA, 601 bp, Human
attacatctctagataaggccgaagtttaaatcttcagttccatttaaaaccggtacgatccatgaacccactctcaactgagtaagaacagaaaataattacgagctgtcaacggaacactatctcacatcaagcacagctggcttccaaatctcacatgacagatgactgaaggtcaaaccctgctccccctaattattttgttaagataatcaacatgtaaactcgaaagccaggggacaagaccaatcactcatgtgttctgaatccccaaaaatggccagaggagtctctctggayttagttagctgagggaaaaagatgtttttgcatttgttttgttttgttttttggtattacgaaaggaccaaccccgtatgtcaaagcataaggtaaacctgttaaatgcaatttgccaacaaggccataaaaaccaaactgcttccagaccccagaagcagatgtatgcttctgccgccacgcaaacccgccgcagcatcaagcctaaagaggcacttctgaactcccaagacagagactcttaaaggccagaacagcagaggaggctgcttcaaagttccgtacgtcctggcaaaaagt

SEQ ID NO: 206223 - DNA, 601 bp, Human
cctgtcatcatgggatggcactgcccttcaggtgatgcaagttaagccctaggtccattacacaacatcagcttctttggtttgaacatcaccctataattacatctctagataaggccgaagtttaaatcttcagttccatttaaaaccggtacgatccatgaacccactctcaactgagtaagaacagaaaataattacgagctgtcaacggaacactatctcacatcaagcacagctggcttccaaatctcacatgacagatgactgaaggtcaaaccctgctccccctaattatttygttaagataatcaacatgtaaactcgaaagccaggggacaagaccaatcactcatgtgttctgaatccccaaaaatggccagaggagtctctctggatttagttagctgagggaaaaagatgtttttgcatttgttttgttttgttttttggtattacgaaaggaccaaccccgtatgtcaaagcataaggtaaacctgttaaatgcaatttgccaacaaggccataaaaaccaaactgcttccagaccccagaagcagatgtatgcttctgccgccacgcaaacccgccgcagcatcaa

SEQ ID NO: 206224 - DNA, 601 bp, Human
cgagagaattagcacagattcttcgggtctcagtgttcctcgggcttagtttctgttcggcttggcttaagtagctattgattacccatgcctggcacacttccaccagcaaatacccactacagctggttctctgctgctgtggtctgatttaacagggccatgtgacaaagttggtgctgtggacttcagactagacagtaaaatagatgctgacgttcacagagaggtgccgtctacttggtctctacttaagaaagtgggggtcagggatgttttcttccccttgccgtccagagcrgctggatgtgctgccctccagcacctttctagctgcttgcaagagctcccaccctctgcttctctgtcctctggatgccgcacttccaaagcagacgttccaaatgcatttggtcaacagaatcaaccagaagcatgagcttctctaacggctaacacaggatacaagtcatgttttccattctgcaaaacctggacacacctgagcatttatcctcacagagagaaagactaacccatcacacggtcagcaacaaatattcacattcggcttttaggattaaaaggcaatccggtggtc

SEQ ID NO: 206225 - DNA, 601 bp, Human
ccaggactgtgtctcctccactcactaccatacacacagcagagcacaaagcctagctctgaacgacagagcaggtcctcccgtggaccccgcatctagcctggcctttcccagttgagaccaggcaacctccactgactgccccaaacaggcactcgagggctgcgaggagtccacgccatgcaccatcactggaacgttccaccacggtgacgagagaattagcacagattcttcgggtctcagtgttcctcgggcttagtttctgttcggcttggcttaagtagctattgattacccrtgcctggcacacttccaccagcaaatacccactacagctggttctctgctgctgtggtctgatttaacagggccatgtgacaaagttggtgctgtggacttcagactagacagtaaaatagatgctgacgttcacagagaggtgccgtctacttggtctctacttaagaaagtgggggtcagggatgttttcttccccttgccgtccagagcagctggatgtgctgccctccagcacctttctagctgcttgcaagagctcccaccctctgcttctctgtcctctggatgccgcacttcc

SEQ ID NO: 206226 - DNA, 601 bp, Human
aaaattatggaacttcactttctttttttttttttttttgagatggagtctcactctgtcgcccaggctggagtgcagtggcgcgatctctgctcactgcaaactacacctcccgggttcacgccattctcctgcctcagcctcccgagtagctgggactacaggcgcctgccaccacgcccggttatttttttgtatttttagtagagacggggtttcaccgtgttagccaggatggtctcgatctcctgacctcgtgatccgcccgcctcagcctcccaaagtgctgggattacaggcrtgaaccaccgcgccccgcctggaacttcattttcttaaaaaaaacacaagtggtcacaaaaatataaatagttattagtcacctcatgtgcgccaaaaattgtagatataaaactgagcatgagtggaaaacacacattaaaagtgttcttagtattatacaagtaaacatctgaaccagctattccctcttacctgtaatggaaaccggaaggcaggtgagactttaagtaatgactcccttatcacaagggttttgcctggaatactgtgtatcttgtctacaaagatgtgcaaaatt

SEQ ID NO: 206227 - DNA, 601 bp, Human
gctccaccaaggaccctttccttttgagtgttctccccgaacttttccccggcttctattcccgactctgggtctgtttctttctagatgggaaggtgtcagaatgtttagggttgcaatggctctttcttgcctcaatactaccttaagggactggggctggggtcaggaaatgcactacacaccctagaatcttctttttgccttgggtgctgtgttcatgctcatacgagtctcaatatttcttcctctgctcccagtctagaatccatttggaaatcaaaacaggagtcaggtggayggagatgaaaatactggccttctgactaaagagtctggttttgggtttgtagccaagtaggctcctgaccactgccatagtgggacaaacgcaggggaggtggccctacaactctggcaggaggaaggcatgtcccctgtggggagggcggctcccaaagagagaacctggagggaatctacagggcctgagccccacctgcttactgccttccccaaaatccaccagtcaagcaagtcactccttccccgagcaaagggggataagggatggcaggagaggcaagagaatcacagtagc

SEQ ID NO: 206228 - DNA, 601 bp, Human
gttttatatcatctatatgcttattattcttatacaatatagagcactcttgaacaggctacttctctttcatagtttctcttcttaccctgtttttcatctgacttttgtgtgctagttttcctctcgccctcttttcttttgggacggtgtttcggagctgccatgtcgtccctttccagcatccctgtggtagccctccaccagcctgttctcagacgtgctcgaggccagtttttcctgattctgtttctacctggtttgtcttcttggaccagagctagagtttgacagacagacrctgctttcaatccctgtctgaggaaagggagatgatgagagctgggaacttgtctggggctagtggattttctcctgctagctagtaagtgtcccaacctccagtggactcctgcctcgagctgtggtcagcacagagctctgggtgcctccacacttcctggctccaccaaggaccctttccttttgagtgttctccccgaacttttccccggcttctattcccgactctgggtctgtttctttctagatgggaaggtgtcagaatgtttagggttgcaatggctctttcttgcctcaa

SEQ ID NO: 206229 - DNA, 601 bp, Human
ccgtgagcagtgcagaggacagaacaggactcctgactgcagtgacaccaggacgtgacttagaatagggcagatggcaggaccaatgtcagaaccactcagagaaaggagttataatgaaggaaagaatcacctaattataaaaacataccaaagaaaatattcatgtatatctatcatgaggtattgctaattaactacaaaaacatcgcgcaaatttttttagaagactcaattcaagattgaagtcttttaacctacttcaaaaacacctacatttgaaacattctccctacccccratactttatttaaaatttttttttaattaatgaaagactagaaaaagggcgtcttactttaccagaagagttctaatttgctccagataacaggaaagaactcaggcaagttggtggctcttttcctgaagttaccaagaattaagaaacaagacaagtttccaattaaaaaagaaaatgccgaagatgttgtggtctccttggcagatatttacacattctaaaaatattcaagattacaaaaattgtaaagcaagattcaaaccagaaattaaaacacctacaattcaaaatgaaaac

SEQ ID NO: 206230 - DNA, 601 bp, Human
ccttcagcaggtaaatggataaacaaagtgtggtatatccatacaaaggtatacaactccataatgaaaagaaataaactaacatgccacggaaagacacagaaaccttaaatatgtattgctaagtgaaagaagcccatgtgaaaaggctacatattcctgattccaactacaggacattctggaaaaggaaaaacgatggagacagtaaacgctcagaggctgccaggggttgaggggagacagggaaggagggatgaacaggtagaacaaggaggatttttagggcagtgaaactatkttgaatgatgccataacggtggagacatttgtcaaaacccacagaactatgcaacacaacgagtgaaccctaatgcaaactatggacttcagttaataatatattcatattcactcacaactttcccaaccctagcacactaatgcaagatgttactcacaggggaaaactggtgtgggggaggcaggcagtatgtgggaaatctgtattttctgctcagtttttctgtaaacctaaaattaagtgataaagtatattaattttaaaaaagtgaaggaagccagacacaaaaggtcacat

SEQ ID NO: 206231 - DNA, 601 bp, Human
aggcacccaacaggaaacaagcaggacactcaaattaggaactaatcacaaaggtgtgggggaagcccgagaaacaagacagaaggaatcctggggcgtgggaggggagaagaaatactgaacctcactctctcccctccctccctccgagctcttgccaggacttcccactggccaaccagaagccagaaagcacaacactcgctgctacaatctatacaggtcaccccaagagcagagagctgacagaagcaggagagagggcgggaaggggcggacagaagcttcccagcatgtgcgcccccagcagtgtatgaagacgctttcctcttttccctaaaggggtgtgttttcatttcacataatatgaagacgccatgaagaagatgtaaactagggaaggaggtgctggagagaagggagctatctcagagaggaggagaagtgcgtttgtgccatcatacagctactgtggtcatttctggctgagaaggtatcgagctgatgggaggctgagggccgctatagttttgtaaacaggaaagcagccttatgaaaaatgcctgagaaaacgtgtgctggcgtttgcgtccaggacact

SEQ ID NO: 206232 - DNA, 601 bp, Human
aaatatcagctgattcaccgacttattaaaagctgtgtagtgcccatcacacaccacagttcaatcagtcagccccaacaggtggcgattaggtcattccaggattttaacaatgcaaatcaaaccgcaataaaaaaatccctgctgctcaaagcgtagctgagggccggtggcagcacagccatcacctaggagctcacagacctcccaggcctactgaatagaatctgcatttgaacagcatggccaggtgaccacaggcacaggaagtccaagaaccactttccgactaaagacaagkgaggaggcccctctccctcaggccccgtgagggtgaggtctgcacctgcgggtggacagacacctggcttgcctcctcctagatctcgctctgggtagtacccaagactccatgaccatatctaaacatcagactgccaccaaaagacaggttacaacaatttacatcctaaatccaggcacccaacaggaaacaagcaggacactcaaattaggaactaatcacaaaggtgtgggggaagcccgagaaacaagacagaaggaatcctggggcgtgggaggggagaagaaatactgaacc

SEQ ID NO: 206233 - DNA, 601 bp, Human
aaataaaaatgcaatcctcaatgtcaaaggatctttcattctagttggctaggcaagctaaaaaaaaaattaaaaattaaaaaagcatgttgcagacataataaagcacaaactacctactaatatctataaaacccaatgcaaatgagtaaacttcatagaataaagagcatgcagtaaaattacttagagaaagaagcaatgtcttttctaagactctttttcccatgaaaataatgcgcattctagaaaacagagataagggcaataaaaataaatcccctttaattagagagaaacrctcattacatgttagtgtcattaccatatgccaccaccattctttttgctcacattcaaaacatggttcctaaaagatagttgactccttttccagttgaacagatcacacccatgtctgcctgtctcaaaaatggtattttcaacatcaacactttcacaacatttctaggatctgaccgcttcccagcatctccactcctaacacgctggtcccacagatcaggatgacagcctctcactgcccccacgtccacctggtctccctcagtgagggtggccagggcaaccccgtgaatgt

SEQ ID NO: 206234 - DNA, 601 bp, Human
ctcccattactggaattcaacatggtttaggagattaaagacactgagtctttcagggacattacagttaccaaccactctgatggccttgaagaaagtaactttaattctcagtaactatttgtatattatttgtaactaaaaacgtggggtccgaggcatcatctatggcaggctttgttggagggccttttccaggcttcctggtgtagtccagagacggccccataccctgaagaacccttctgtctgcttcatccagcatacacacaaacccaagggaccccgccttccccagctytacagagacaagagggaactatttatataaaaaggctacttatctgactgaaggctgatagcagtaagggcaaaagcgtgttctgacactccaacttcaaccgcagccccaattcaggactttgacggcatatgcaggaggagtgcttggggaaggtaacaggaacagagggcataaggaagaacaaatgagaaccttcaagaattagacaatcattctttggtctttcaagcatgctaataataaccctctgcagatttagaaaaataaaactgttcgggaagaggccagtcgttgctt

SEQ ID NO: 206235 - DNA, 601 bp, Human
tgcccattccctggcctcccattactggaattcaacatggtttaggagattaaagacactgagtctttcagggacattacagttaccaaccactctgatggccttgaagaaagtaactttaattctcagtaactatttgtatattatttgtaactaaaaacgtggggtccgaggcatcatctatggcaggctttgttggagggccttttccaggcttcctggtgtagtccagagacggccccataccctgaagaacccttctgtctgcttcatccagcatacacacaaacccaagggaccycgccttccccagctttacagagacaagagggaactatttatataaaaaggctacttatctgactgaaggctgatagcagtaagggcaaaagcgtgttctgacactccaacttcaaccgcagccccaattcaggactttgacggcatatgcaggaggagtgcttggggaaggtaacaggaacagagggcataaggaagaacaaatgagaaccttcaagaattagacaatcattctttggtctttcaagcatgctaataataaccctctgcagatttagaaaaataaaactgttcgggaaga

SEQ ID NO: 206236 - DNA, 601 bp, Human
caggagtttgagaccaggctgggcaacatagtgagtccttgtttctacagaaaaattagccaggcgtggtggtgcgtgcctgtggtcccagctacacaggaggctgaactgagaggatcacttgagtccagaaagtaaaggctgcagcgagctatgatcgccccactgcactccagcctgggcgacagagtaagactccgtttccaaaagaaaagaaagatttaaagacaatgacttggaaaggagttgaaggagataaacactcaaccccctcagtccctaagagagtctgctcagcccmctcctagatgtgataaaaaggtgctccctagattcactatcagtcctctgcccattccctggcctcccattactggaattcaacatggtttaggagattaaagacactgagtctttcagggacattacagttaccaaccactctgatggccttgaagaaagtaactttaattctcagtaactatttgtatattatttgtaactaaaaacgtggggtccgaggcatcatctatggcaggctttgttggagggccttttccaggcttcctggtgtagtccagagacggccccataccctgaa

SEQ ID NO: 206237 - DNA, 601 bp, Human
gtgagccgctcgctgctggttctgagttgcaggggctgcaagcaagactggagggaggcctccaggagccgagggaggtcagaaaagaaaccggacctcagtcctacagctgcaaggacctgaacccttgccacaacctgaatgaccttggatgccgatgcattcccagagcctccaaaaaggaacacagtccggctggaaccttcctgttagtctcatgacactcagggcaaccaactgagccacactgtgcccagacctctgacccaagcaactaggagctaacaaataaatgttttawgtcccgaagcctgtggtaatttgttacagtggcaacagaaaaccaaaacagctgtggaggtgtatgtgactcattactgaaaggtgagtttataagtgagaaacacaataaccaaaagcagtccccttaagaaattccctagtctgcataaaagacaaataatccaaattaaaaaaatgggcaaaggatctgtatagccatatctccaaagaagatacgcaaatggcccataagcacatgaaaagatgctatacctcattcaccatcgaggaaaggcaaaccgaaaacgggatggctgga

SEQ ID NO: 206238 - DNA, 601 bp, Human
gggaacctaggtgaaaggtctttgcagaggtaattaaggctaccaatcagctgagcttaaaatagggcgattattctggattaccctgcgagcctgatggagtcaccagtccttacaagcagatgtggaaggtggaaaagtctggcaggttccttgtgagccgctcgctgctggttctgagttgcaggggctgcaagcaagactggagggaggcctccaggagccgagggaggtcagaaaagaaaccggacctcagtcctacagctgcaaggacctgaacccttgccacaacctgaatgamcttggatgccgatgcattcccagagcctccaaaaaggaacacagtccggctggaaccttcctgttagtctcatgacactcagggcaaccaactgagccacactgtgcccagacctctgacccaagcaactaggagctaacaaataaatgttttatgtcccgaagcctgtggtaatttgttacagtggcaacagaaaaccaaaacagctgtggaggtgtatgtgactcattactgaaaggtgagtttataagtgagaaacacaataaccaaaagcagtccccttaagaaattccctagtct

SEQ ID NO: 206239 - DNA, 601 bp, Human
gcactttgggaggccaaggcacacagattgcctgaggtcaggagttcgagaccagcctgggcaacatggtgaaaccccgactctaataaaaacacaaacaatatttgggcatggtggcggagccctgtagtcccagctcctcaagtggctgaggcatgagaattgcccgagcccaggaggtggaggttgcagtgagccgagatcgcgccactacactccagcgtgggtgacagagaccctaacttgaaaaaaaaaaaaaaaagcaaaggacaaacgaacaagggagggaggcgactcaaastggcctctcccacaggtttcgcttgccgttttcacttactctctctgaccagcctcacaaccctttcatggtcccctgtaactagaaggctgtaaggcaggccacaagcccgtggcacgggcagaattctaaagatggccgggggtattcatcaattgggaacctaggtgaaaggtctttgcagaggtaattaaggctaccaatcagctgagcttaaaatagggcgattattctggattaccctgcgagcctgatggagtcaccagtccttacaagcagatgtggaaggtggaaaagtct

SEQ ID NO: 206240 - DNA, 601 bp, Human
aacatgtacagaacacaaattgaataattatccagctcatgccagggtttcctcggtgggaagggcagtagcagcagtgacagtgagaatgatattgaagctaacattcactgaacacctactctgtccaggcacaggtctagcacacattaactcattcaattcttaagagcggccaggagacagccatgattactgtccccatttcacagatgagaaaactcaggctagagaaatgatcaggaatgtgcaatgcactccggtgacttcttaccacctcctctgctcccatcaagtcagyctgggtctctgctgctcttcactgatgcccctgctctcattcttgcccacttccacctcctacccctggaggaggtctacactccccacttaacaaacaatgacccttttaaaaacacagttgggtcagttcaactctctacttaaactttccaatggcttcccatcatactccactttatttttatttatttatttttgagacagagtctcgctctattgcccaggctgtagcgcaatggcgcgacctcggctcaccgcaacctccacctccagggttcaagcgattctcctgtctcag

SEQ ID NO: 206241 - DNA, 601 bp, Human
atatacatattgattatggactcaaaacatgtacagaacacaaattgaataattatccagctcatgccagggtttcctcggtgggaagggcagtagcagcagtgacagtgagaatgatattgaagctaacattcactgaacacctactctgtccaggcacaggtctagcacacattaactcattcaattcttaagagcggccaggagacagccatgattactgtccccatttcacagatgagaaaactcaggctagagaaatgatcaggaatgtgcaatgcactccggtgacttcttaccrcctcctctgctcccatcaagtcagtctgggtctctgctgctcttcactgatgcccctgctctcattcttgcccacttccacctcctacccctggaggaggtctacactccccacttaacaaacaatgacccttttaaaaacacagttgggtcagttcaactctctacttaaactttccaatggcttcccatcatactccactttatttttatttatttatttttgagacagagtctcgctctattgcccaggctgtagcgcaatggcgcgacctcggctcaccgcaacctccacctccag

SEQ ID NO: 206242 - DNA, 601 bp, Human
taggtgctcaaaacggcagcactttcggtttccatctggtatgcttcccgaaccctgcaagtcaacatttaagaattcctataatctgaattaaagacaattagagacatcagaataaagccctgctcaagcttctccaagctcacaaataaaatcaaagacacaaaccaagactttgaggaaatttcttctgcacccatgaagtctttactgggaaggccttctcagtgcggccttactggaccatcctatttaaagccgcaactcccaccaaaaaatttcttatttccttttcctgcctttttttttttttttcgtggcatagaatctcagagctggaaggagctctaaaaggctggaccagtcaccgtccagatgtgaactccttgcatataacggccttccacagtagtttatcagcctgtccaacacacatcctagaaagggttccctgacctgccccgcactgctcccaagcacccttcctgtgctcccgacagcaccgggtgtgcactgctcccctccacagcactcactcacacgactgccaggcatccttgctaggcacggcctgggaaacattctccgtttcatttcaaat

SEQ ID NO: 206243 - DNA, 601 bp, Human
gacccagggtgtgcaatgagtaggtgctcaaaacggcagcactttcggtttccatctggtatgcttcccgaaccctgcaagtcaacatttaagaattcctataatctgaattaaagacaattagagacatcagaataaagccctgctcaagcttctccaagctcacaaataaaatcaaagacacaaaccaagactttgaggaaatttcttctgcacccatgaagtctttactgggaaggccttctcagtgcggccttactggaccatcctatttaaagccgcaactcccaccaaaaaattycttatttccttttcctgcctttttttttttttttcgtggcatagaatctcagagctggaaggagctctaaaaggctggaccagtcaccgtccagatgtgaactccttgcatataacggccttccacagtagtttatcagcctgtccaacacacatcctagaaagggttccctgacctgccccgcactgctcccaagcacccttcctgtgctcccgacagcaccgggtgtgcactgctcccctccacagcactcactcacacgactgccaggcatccttgctaggcacggcctgggaaaca

SEQ ID NO: 206244 - DNA, 601 bp, Human
aggttctcaggccttcggacatgagctgagtttgaatcacgcctcgggcttccctgggtctctagcttgccacacagaacatgggacttctcagctcccagaatcacgtgagtgaaattctccatcataaatctccttttatacatctatgtatcctgttggctgtgcttctttggagaatcctgactgagatcagggagatctgtggccgaggagttgaacggagtgagactcaccctggacccagggtgtgcaatgagtaggtgctcaaaacggcagcactttcggtttccatctggtrtgcttcccgaaccctgcaagtcaacatttaagaattcctataatctgaattaaagacaattagagacatcagaataaagccctgctcaagcttctccaagctcacaaataaaatcaaagacacaaaccaagactttgaggaaatttcttctgcacccatgaagtctttactgggaaggccttctcagtgcggccttactggaccatcctatttaaagccgcaactcccaccaaaaaatttcttatttccttttcctgcctttttttttttttttcgtggcatagaatctcagagctggaa

SEQ ID NO: 206245 - DNA, 601 bp, Human
ataagatgtggaaggaggccctggagtgctctcattcaacagggacacccaggcccgcagctcagcctttggagatggcaagtcccaagaatcagaagaaacagatgcttcctgagtcgtcaagtgaggggatttcatctcccagcagcaaaaaggagatcagaattggaaaggaaatacagactacaaggaaccctggcccagagcccccaggctgtgcacacgtgggctccaggcgaaccatttcaggttcagggaagacggctcagcctaacctgggtggggctgacttctgtgcacracatctacacctggccctctgtgcacaaccagagctccccgctccaccgatgcccagagcacagcgactgtgctgcaagcggggtgacctggctgatgacaccgcggctcacacagaagacaaaggagcaacaaagctgccagaactctagtttcccagccttggcagagaaagcccagaacaaccagggtgctcacatgttccagaggtacaggagaataagtgtgctgcttcttcttactcagataactttatgtcatgaccaatgaagtaacttttatcaaatttttgccaactata

SEQ ID NO: 206246 - DNA, 601 bp, Human
tgatttctcactgtgtcctcagatggtggaaggggtatacaagctcattaaggtcccttttataaggacactaatcacattcatgagggctctgtccttgtgatctcatcactccccaaaggccccaccccctaacaccagcaccttaagggttaggatttcaacataggaattttgagatggacacattcagaccatagcactgcaaatgagtaaaataataacagtattagtaatactgctaacaaaaaccatgctacagcctttagaaggaacttactccttgggttttgtcaataattttttttttacagttggattccaaatgatggacctcacggtcactggcaagataatgagaaaagtccgggcacagtggctcacttctgtaatcccagcactttgggaggctgaggcgggcagatcacctgaggtcgagaccagcctggccaacatgttaaagccctatctatctctgctaaaaacacaaaattaggtgggtatgagcatggtggcaggtgcctgtgatcccagctacgtgggaggttgaggcaagagaatcacttgaacccaggaggcaaaggttgccgtgagccatgat

SEQ ID NO: 206247 - DNA, 601 bp, Human
gggctgctataacaaaacctcacaggcgggtggcttgaacagcagagatttctttctcacagttctggaggctgggactctaagatggagactggtgtctggtgagggcccactttctggctcctagacggtgatttctcactgtgtcctcagatggtggaaggggtatacaagctcattaaggtcccttttataaggacactaatcacattcatgagggctctgtccttgtgatctcatcactccccaaaggccccaccccctaacaccagcaccttaagggttaggatttcaacatagraattttgagatggacacattcagaccatagcactgcaaatgagtaaaataataacagtattagtaatactgctaacaaaaaccatgctacagcctttagaaggaacttactccttgggttttgtcaataattttttttttacagttggattccaaatgatggacctcacggtcactggcaagataatgagaaaagtccgggcacagtggctcacttctgtaatcccagcactttgggaggctgaggcgggcagatcacctgaggtcgagaccagcctggccaacatgttaaagccctatc

SEQ ID NO: 206248 - DNA, 601 bp, Human
tccctcctgtaagcagtgaccatcatgagtagtgctacccgacacccacctagagcagcgccttcagtgcttacggcctgcacttgggttaagccagagctggcctacccaggccctgctaccatgctgcctgaaaagctgcttctgcaccttctgcagatcagcaagggtgtgggccgagctgactgtggccttggaggctgtctgtccctgcaggctggccactggctgtagtaggagagtgcccaggtgctgtgggttaccctggaccatcctgtgggcctgaatttggatgggatgsagagggacctgggccgcacaggaggacctcactccccacagagcagcagcggcctgcagctaggggagatgcaccatcctgaggtctggcccagcctgtcagccaatgccgtggttctaccttccagagacagctacaatttccctacttcctgctgctcccatggctctcacttgggtccggccaccaccatctctcacctggattatggcaagtcttctaattggctgctttgtgtccacacttgtccccttcagtctactgtcaaaaccagtggtcaagttagcctgctaagcctag

SEQ ID NO: 206249 - DNA, 601 bp, Human
tgtgtcccccaggctggagtgcagtggcgcaatcaaagctcactgcagccttgaccgcgcgggctcaagctagagatttttcagctctgttctacactgctgtgagtatctggagagataagggagcagaggaacaggcaggaggcagaagatgcctgggctgccgcctgctctcacgcagcttacagcaggcacggagactagagccagagctgagctgacctctgaggacccaacacttctgaaattctctagaacattttttaaaaatagtaattaaaatctggaagtatgggatatrctgttaagcctggctacattagaagacattttgtgcattcagacactacttgagtctaatatctccagacactgaaaacactcactcatctacgctatcttggcagcccagcaagagaccatctaatggtggctctgtcccagccacgagggccaccgagcagtggacgtgcggcccagctgaactgagaggtattataaatacatactggatcacaaagagtacaaaaagaacacgtaaacttcttttgtttatactgattacatgttgcaattgtaatattttggatatgttggattc

SEQ ID NO: 206250 - DNA, 601 bp, Human
ggtgaggtctgggaatcacagagctaccactcaacattttctaccactaaagacgttgaagagagctgggcgtgatggcttaagcctgtaatcctagcgctttgggaagccgaggcgggaggatctgttgagcccaggagttggagaccagcctggacaacttaccgagaccctatctctattaaaataaattaaaaaaaaaaagatattgaagaggatacgcagctaatgttcattttagaaaggctgcttttgattatcaaacatgatgtgtgcagcgcatggtggtggtggcaccccyaggcagtgttctttagaaccctcctcctgatccaacctggtcaagctggggcctcagcacactgtggtaaataaaggcccagagcctttccacaaagcctttaaacaccgaccaaggtgccaaataaataagcagatgcagacatgcataaaattcatgccagtctatcaaccaaaaggctgcttcagagaggccataacaatctgcgttcatgggactaagcgcctgccatgtgaacgacactgtgttaagtactcactgtccattagctcatttagtctttataaataactctgcgag

SEQ ID NO: 206251 - DNA, 601 bp, Human
aggtgtgagaaaatggtgaaatctttgtcctctgggggcagtgtcactaggttggttttcattaaacatattcttggcccattcgttggggccatcttggattgcatggtgaggtctgggaatcacagagctaccactcaacattttctaccactaaagacgttgaagagagctgggcgtgatggcttaagcctgtaatcctagcgctttgggaagccgaggcgggaggatctgttgagcccaggagttggagaccagcctggacaacttaccgagaccctatctctattaaaataaattaaaaaaaaaaagatattgaagaggatacgcagctaatgttcattttagaaaggctgcttttgattatcaaacatgatgtgtgcagcgcatggtggtggtggcacccccaggcagtgttctttagaaccctcctcctgatccaacctggtcaagctggggcctcagcacactgtggtaaataaaggcccagagcctttccacaaagcctttaaacaccgaccaaggtgccaaataaataagcagatgcagacatgcataaaattcatgccagtctatcaaccaaaaggctgcttcagagagg

SEQ ID NO: 206252 - DNA, 601 bp, Human
ccaccaggtatctattcaggtgctatttttacaaatgaaaagtttagcttcacaaggagtacaatctcactcagaagttaaatcaataacccctaggaagtttcatttttatgtcaaagacgaagtcagggggccaggtaggacttggaaggccaaaggtcacttacgaagactgcaggactgcacacaccaggccttccccaactatcagggtgaacataggtttggcttaaaaacacacacacgcaaaaccggcccatgcaacagcagtctattcccaccgcacaatccgcccaagcargctggagctggtccaaatgaactgcacccaaccacaagaaaagactcctcctttccctttttcaaaacacaagaaaggtggctaaactactgatgagctttgaacagttaagtagtagttttgtaagctttgtagttacagtccattttcccttcctttgaaggaaaaaaggcattaaaaaaaaaagatgtctctcttttgcccttttacatttattctagtcaaaaactgctctctgccaactttgttctgaaaatccacatctgagttccagcgaagttttctacttggggacatttg

SEQ ID NO: 206253 - DNA, 601 bp, Human
ccgggaaggccctgctcgtccaactcaaatacagaaattgggtccgacccaccaggtatctattcaggtgctatttttacaaatgaaaagtttagcttcacaaggagtacaatctcactcagaagttaaatcaataacccctaggaagtttcatttttatgtcaaagacgaagtcagggggccaggtaggacttggaaggccaaaggtcacttacgaagactgcaggactgcacacaccaggccttccccaactatcagggtgaacataggtttggcttaaaaacacacacacgcaaaacyggcccatgcaacagcagtctattcccaccgcacaatccgcccaagcaagctggagctggtccaaatgaactgcacccaaccacaagaaaagactcctcctttccctttttcaaaacacaagaaaggtggctaaactactgatgagctttgaacagttaagtagtagttttgtaagctttgtagttacagtccattttcccttcctttgaaggaaaaaaggcattaaaaaaaaaagatgtctctcttttgcccttttacatttattctagtcaaaaactgctctctgccaactttgttctg

SEQ ID NO: 206254 - DNA, 601 bp, Human
acgaattagaagattcaacacggtaccaatatccttaaattaataaacaggtttagcacaatttccataaaatcccagcaggatcttttgtagatataaatatgattatttgaaaatttatatgaaaaagcattaaattagctaaagcaactttgaaaaagaaaagtgggaacaatcagtctatctgattttaagacttattatatagctatgataatcaagactgtgtggtattggtgaggtgacagacccacagatcaatggaacataacagagaacccagggatagcccctgatacarctaggtaatttttgtaaaagtgcaaaagcaattaaaaagaggaagcctggtcttttcaacaaacgctgttggaggaagtggacttccacaggtaaagaaaattggggggagcgggggagggggtggggaagaaccttgacctaaacctcacagcttatacaaaatcaaatcaaaatgtagaactatatataacataggagaatatcttcaggatgtagggtgtgctcaaagttcttagatgtgactccaaatacatgattcacacgagaaaaattatcaataaattgaacttgatgaaaa

SEQ ID NO: 206255 - DNA, 601 bp, Human
gtttatgagaacttctgtgttcttctgaggggcacactgcatactctctggtatggtctacactgggggtatacagagtggtcaagggccctgagaaggctatcaagtacacatctgtccatctggaaaagccttctcatctcagagcaatctgagggactcaggccagctgagagcagcatcccatcctccaggacagagaaaaccagggtcacctgctcactaggcacttatctatgttccttttttggagactgggtcttgctctgtcacccaggctggagtgcagtggcatgaacakggctcactgcaatctcgaccttctgggctcaagtgatccttgcccgtagcctctcaaggagctgggaccacaggcatgcctcgttacgcccggctaattttaagattttcgtagagtcagggtctcactatattgcccaggctagtctcaaactcctgagctcaactgatcctctggccttagccttccaaagcactaggaattacaggtgtgagccactgcatccggcctttttttttttttcctttttaaataacagttttactgtgctataatccatgtaccatataactcatcaat

SEQ ID NO: 206256 - DNA, 601 bp, Human
tattccaaaagatacaactgcttcttccagcttaaaacgggtgggaaaacatacaaatccaggcagtcagcagtcatgagacaggaaaagactaaaatacgacaagccaagtagcccgcccaccaaaacgggagccaggggatcatgttctagatttaacgtcaccatcgtttgtgatgagaaactacttttcattcttttgcttgtttcctcattgttaaaaataaagttaatgttgttctgccccttcttacctcatcaacagggtcaaagggatgaagaaataactaacatagtattrgggaatgcagccagcctttggaaaatattctctcagcaaaaacagcaccccctgagcagttaggaggtctgttccaccatccttagactaatgtttcgaaatcagcaaggcagtgtttatgagaacttctgtgttcttctgaggggcacactgcatactctctggtatggtctacactgggggtatacagagtggtcaagggccctgagaaggctatcaagtacacatctgtccatctggaaaagccttctcatctcagagcaatctgagggactcaggccagctgagagcagcatccca

SEQ ID NO: 206257 - DNA, 601 bp, Human
ataacgggagatgactgtactgccaagagtactaccagcgctactattgtcatcatcactgaaatctggcagctcctctattccaaaagatacaactgcttcttccagcttaaaacgggtgggaaaacatacaaatccaggcagtcagcagtcatgagacaggaaaagactaaaatacgacaagccaagtagcccgcccaccaaaacgggagccaggggatcatgttctagatttaacgtcaccatcgtttgtgatgagaaactacttttcattcttttgcttgtttcctcattgttaaarataaagttaatgttgttctgccccttcttacctcatcaacagggtcaaagggatgaagaaataactaacatagtattagggaatgcagccagcctttggaaaatattctctcagcaaaaacagcaccccctgagcagttaggaggtctgttccaccatccttagactaatgtttcgaaatcagcaaggcagtgtttatgagaacttctgtgttcttctgaggggcacactgcatactctctggtatggtctacactgggggtatacagagtggtcaagggccctgagaaggctatcaagt

SEQ ID NO: 206258 - DNA, 601 bp, Human
cgaactcctgacctcagctgatccgcccgcctcagcctccccgccaaaaaaacaatgttttaacaacaactatagtagcctccaccccttatccgtggcataagttccaagaccctcagtggatgtctgaacggtaccaagccctacctgtattgtttttaaagtttaatttaatttatgaattaggcacagtaagagattaataatagctaataataaaatacaacaattataacaatatactgtcatgaaagttaagtaaatatggtctctccttctgtctctcaaatgtggtatcacygtccgcgcctattttccgttggcggctggctgtggataacgggagatgactgtactgccaagagtactaccagcgctactattgtcatcatcactgaaatctggcagctcctctattccaaaagatacaactgcttcttccagcttaaaacgggtgggaaaacatacaaatccaggcagtcagcagtcatgagacaggaaaagactaaaatacgacaagccaagtagcccgcccaccaaaacgggagccaggggatcatgttctagatttaacgtcaccatcgtttgtgatgagaaacta

SEQ ID NO: 206259 - DNA, 601 bp, Human
caaagctactggaaaaaagacaactgggcggggaggaggtggcaacaatttcagaaaatttcactggaaaatgaagtgtatcagtaaaaaaacaacttttttttttttttttttcttagatggagtttcactctttttgccctggcctggagtgcaatggagtgatctcggctcactgcaacctccgcctcccaggttcaagcaattctcctgcctcagcctcctaagtagctaggattacaggtacctgccaccaggcccggctaattttttatttttagctgagattacagaccaccayggactgctaatttttgtatttttagtagagaggggggttccaccatgttgtccagcctggtctcgaactcctgacctcagctgatccgcccgcctcagcctccccgccaaaaaaacaatgttttaacaacaactatagtagcctccaccccttatccgtggcataagttccaagaccctcagtggatgtctgaacggtaccaagccctacctgtattgtttttaaagtttaatttaatttatgaattaggcacagtaagagattaataatagctaataataaaatacaacaattataaca

SEQ ID NO: 206260 - DNA, 601 bp, Human
agggtggggcatggtggctcacacctgaaatcccagcactttgggaggccgaggcgggtggatcacctgaggccaggagttcgagaccagcctggccaacatggtaaaactccatctccactaaaaaatataaaaattagctggtgtggtggtgggtgcctacagtctctgctactcgggaggctgaggtgggagaatcacttgaatccagaggtggaggttgcagtgagctgagatggcgccactgcactccagcctgggcaacagcgcgagactccatctcaaaaaaaaaaaaaaaggaaaaaaaaagacgtttccaatagcaaaatatgaaaaacagttcaaaagtacctcaatgaaagaaggaatggatcctagtatctttccacagtggagcatcagacagcagtgaaaagggaagaaccgctgctatgtgcctcgcctgatgaaattccaacatgtggagtgaaaaaggcaagtcacagaagcatatatactatacactaagaaatgacttatatgaaggttaagaatcagtaaaactcaagactgtcgtgtttacaaataataaatgggtattatggcaaaatcataagaacgg

SEQ ID NO: 206261 - DNA, 601 bp, Human
gggtaaaagatatgaatagggtggggcatggtggctcacacctgaaatcccagcactttgggaggccgaggcgggtggatcacctgaggccaggagttcgagaccagcctggccaacatggtaaaactccatctccactaaaaaatataaaaattagctggtgtggtggtgggtgcctacagtctctgctactcgggaggctgaggtgggagaatcacttgaatccagaggtggaggttgcagtgagctgagatggcgccactgcactccagcctgggcaacagcgcgagactccatctcaaaaaaaaaaaaaaaggaaaaaaaaagacgtttccaatagcaaaatatgaaaaacagttcaaaagtacctcaatgaaagaaggaatggatcctagtatctttccacagtggagcatcagacagcagtgaaaagggaagaaccgctgctatgtgcctcgcctgatgaaattccaacatgtggagtgaaaaaggcaagtcacagaagcatatatactatacactaagaaatgacttatatgaaggttaagaatcagtaaaactcaagactgtcgtgtttacaaataataaatgggtattatgg

SEQ ID NO: 206262 - DNA, 601 bp, Human
tctgcaggaaaaggatgggtaaaagatatgaatagggtggggcatggtggctcacacctgaaatcccagcactttgggaggccgaggcgggtggatcacctgaggccaggagttcgagaccagcctggccaacatggtaaaactccatctccactaaaaaatataaaaattagctggtgtggtggtgggtgcctacagtctctgctactcgggaggctgaggtgggagaatcacttgaatccagaggtggaggttgcagtgagctgagatggcgccactgcactccagcctgggcaacagygcgagactccatctcaaaaaaaaaaaaaaaggaaaaaaaaagacgtttccaatagcaaaatatgaaaaacagttcaaaagtacctcaatgaaagaaggaatggatcctagtatctttccacagtggagcatcagacagcagtgaaaagggaagaaccgctgctatgtgcctcgcctgatgaaattccaacatgtggagtgaaaaaggcaagtcacagaagcatatatactatacactaagaaatgacttatatgaaggttaagaatcagtaaaactcaagactgtcgtgtttacaaataa

SEQ ID NO: 206263 - DNA, 601 bp, Human
gccctagaaaagctttgacactcaggaaaagattggaagagaaacaagggtctactgcaggggtgggggagggagccctggtaacggtgacttcagatgggtatggtctttcagttttgctgtaattgtgtattttgacaacaacgactattagggtcctactatctagctattttaataaaatgctccatcattttttttgaagaataaaaagaagggcaaatgtataaagtataggaataacagtcatgcacccaccacccaataaacaagaatttcacatcatcatctctgcatctgrttattacagactttacaaatgcatcactgactacaacagtatattttctgtatcttcacaaagtctcatggtctgaagcataagatcgaaccaaagggacgactactgacccacctgtggccaccttaccctaatcacccgccaagtgcacgtctagattaaaagctcactcgctggagacaggctcatgtttggtcttcttcactgctatatccccagcatgtagcaccgggtctcacacagtaggtgatccatgaatgcagaatgaatgaatgaatgagtgaagaaggggagaaacaa

SEQ ID NO: 206264 - DNA, 601 bp, Human
agaagataatatttatattagttataccgatgaccaaagtctttctgttgagcatcctgctctgtcttacttaactgtgttttggaagataaggtctaacatggcgagatcatcttccttttaactgagccacagaagtgatgctcatggggtgtctgctgtctgtgaccagcagtggacagcaatggccaggcatggcaaggggccagtggggaaggcggccaggctgcctcccctatggaaagggaagatttccatcccccaccccggcccaccctgctcctctcagaggagaaagggycgtcacaaggtaatcaccagacacagccttttttcctcctctttttgtttctatctctgactggaatggcaggaaaaagcaagacggcagagggaacagggaggcgcctagtacctggctgacagcaattctcaaagcagctgcagctcttcacagggactgtcaaatgctgtcagctggggaagaaagacaagcaaaaaacaaggtgatgaagcattgccctagaaaagctttgacactcaggaaaagattggaagagaaacaagggtctactgcaggggtgggggagggagccctggt

SEQ ID NO: 206265 - DNA, 601 bp, Human
acagcacgcctctgaccaattcctaagtccttccggcagccctcaggcgcccctccacaggcaccacgagctgtcgcctgtcacccaccgctctggcccacctcccgtcagcctccctgctgcactctggagcacgaagcctgctcccgcctaggggcctctgcgcttgccattcttccagctacaacactcttctcccttcccccaggcacccaccatcttctgagctttccgggaaacgccactctgggaagctacgttggtgagagctaaagccaagacacagaggcttaaacaagayaggctgaaggccgcttccgttgtgggtccacgctgactgctcagattcttgacactggccaggcatcgggaagggggagaggccgggggtaagtgtcatttcgcccctacagcaaggcccagcactcagtcccacggctatgctaaaccacaagaaggcagaaaatgtagtccagatttgtggtcatcttctcaactctgttaccacggcagagagaaaacaaatgccagggccgggcaccatggctcacgcctggaatcccagagctttggaagccgaggcaggaggatcacctgaggt

SEQ ID NO: 206266 - DNA, 601 bp, Human
acaagctgtggtacctccatactagggaatactactcagaaataaaaaggtacaatggctcatgcctgtaatcccagcactttgggagactgaggtgggtggatcacctgagttcaggagttcaagaccagcctggccaacatggcgaaaccatatctctactaaaaatacgaaaaataaaaaaataaataaaaaattagtcaggtgtggtggcggacgcctgtaatcccagctagtcgggaggctgaggcaggacaatcgcttgaacccaggaggtgaaggttgcagtgagctgagatcrcaccactgcactccagcctgggtgacacagcgagattccgtttaaaaagaaggtacactggaaaggggcggcatgagggaggccatggtgggagatggttctgtatttcgactgtggtgttacacatgtaatacagtgacacagtactacatgcacacgctcaccaatgccagtctcctggttttcatcccgtgctataatcctgtaagatgtcatcattggggggagaccaggtgacacacacaaggactatctgtgtaacttcatgtgaatctgtaattagttcaaaatgaaaaattg

SEQ ID NO: 206267 - DNA, 601 bp, Human
aaacacctttgttataggttgcaattttccccaaatttgtcatttgactcttaatttatgttgacttttgccatacaaatgttaaaaacgtttatgtattcaaatccatcattattttcctttagggtttctggtcttgctgtcacataaagtatttcattattaactctattacatcacacatttttaccctgggccactatgtactggcttaaggatctatgttaaaatacttaacacttcatttttttcccctagaggagtagatttttagaggtttataagtatataatactcttcrtgattaatgaaatgaaggggaaaggccaacatcacaggcagaaacacattaagtttctcaccagtgcaggatccaagaatagcaaatacctcagcttcctgcttctgtatcctcaggcaagagccaccccagaggaaaagcaagtgtcccacccgctccagagctgggatcagcacccaagtaagcatgagactacccaggctactctaaattcttctcaagcctgtctgggtcattcattagctttgtcacgtcaggcaaatttcttcaagtctcagacctcaaacggtgtcaatatca

SEQ ID NO: 206268 - DNA, 601 bp, Human
ttaataaccttggatttggcaacaaattcttagctttgacaccaaaagtgaaaacaaaagaaaaaagagatgttagtcttcatattatttcttacacatttcaaaccttccatcagaaatcacattcttcctgtttcaagtgtagttcctatgattcctgttgggaggatttgctacccatcaactctctgtgtttggaaatgtctctgttctgccttctattttacaaaactcaattagattgagagttaagctctcttgtagacaccacctcgagatatcattccactctttctggcgcctgctgtagcttttgggaagaaagctgtcaaactgtcactccttgaaagttcacgtctacctttttctgtagctgcttttaagattttcctctttgtgtttggttttctgcagttttattatgtctatagtgttttggttttttttttttaatcttgcttgggattcactgggtttcttgactgtttgatatgatttaccagccaccgtcacttcaaacatggtgctgccccgacttttcttcctgtgactcagtgttaaacgtgcattacaccttctgaccccatcctccttcctcctg

SEQ ID NO: 206269 - DNA, 601 bp, Human
tgacagagcagcggaacggggagttaaaaccctggctaagacaggggcgatgaaagcatgaagggctggcccacattcaacggctaaaggacgtccccattcgatgttcctgttttgtggatcagggaaagaggggctgggaaggaggctggtgtgaccacacaattcttgccgagagaggagcaggctggcataaggattacacatttttcttccttccttgcatcacctcagcttggccaccctgctcccacttggtgcagtgatcctaggaccaggtcttgcaaccccagtgctggargcagagctggttcctaagcaagaaactgtactgtttttaaaccttacgtcggggccaggagaggtggctcatgcctgtaatccagggactttgggaggctgaggtgggaggatcacttgaacctgaaagttcaagcctgcagtgagctgtgactgtgcagctgtgcttcagcctgggtgacagagactctgtctcaataataaaataagaataaaccttacactggaattccaaggacctgatgggggtgggttgtgcctttaccccatctgggagaactggggttcacggtgactgcag

SEQ ID NO: 206270 - DNA, 601 bp, Human
ataggtagtggtgggtgcggttttgactttaatcaagattgtcaggtaagatttcatgaagataacatctgagtcaaaaccttgatgagataaaggaggaagtgcattccaggcagaaggaacagcaagcacaagggccctgatggcgctgggaggccctgagtgtgcagggagcagcaggaaggccagtgcgcctgcagcagtgacagagaggaggggagcaggagatgggcttgccgaggcaaagggggggtccaggttgctaatgtgtcgaatgctttaatgatataagggtcaaaaraagtacaaggtttgagaacctacagtcaacacgtgtcactgaatcttcattccttttgcacttacaggtttgtcttcctttttatataacttctttcaaaggtaaataaaatcaggcacgtctaagaataaacataagtacaaagcccagggtacttgtttttccccccttttaaacactgtcacatatttacgcagctatctgtgttactgagccaccttcttacctggggttgggttgactcatgcacagtggttggcacagcaggcagtcaagatatgagagtcaatattaataata

SEQ ID NO: 206271 - DNA, 601 bp, Human
gactaactgtcccacactgctggagagactataaaccagtacggccagtttggagaaatagttggcaaacccagcaatcccactcctaggtatatttccaagagaaatcagtgcatatatccattaagagacctgtccaagaatgttcaaagcagctttactcacagtagccaaaaacgagaaacaaacaccatgtctgtgaacaggagaagaaataaattatggtgtattcatttaatggaaggctatatagaaaaaagaagaaaataccaatccacgtagcaacacagatgaatctctsagtcattaagcaaagaagccagctaaacgattccatttaaacaaacttcaaaaacaggcaaaacactaatctacagtgatggaagtgaaactagcgtggtcaccaggaggagtggtatcaatggggaagcagcgggagggactttcttggatgctgaaatgttctttcacgtgggtggtggctgtgtgagtagatacatacgtaaatctcattgtgttgtatacacctaagatttgtgcattttgcacacagaaattatacttcaattaaaacaaataaacaaggctgggggcggtggct

SEQ ID NO: 206272 - DNA, 601 bp, Human
cccatatgctgcaggttaccaggtgctccctttcctggctgagcagtatccccacagaagggtgcaccccagtctgttcatccatctgcttgttgatggccacgttcccaatgttcagctgccataaacatgtgtgtgcaagtctttgtgtggacaaatattttcacttctctttggtaaatatctacatgtggaagggctagctcatgtgataattgtatgtttaacttttaagaaagtgccccgcttttccaaagcaggagtaccatttcacatttctaccaggggtgtgtgagagccygagttcccacccccgccctcactgtgccttgggtggtcgccttccaaagggcagcctcctaggagagcatgtggtgtctcaccacggtgttcaactgcatgtgtgtcatgactgatgacgtcgactgagcatcttttcatgtgttatttgcttcaggaatctcttctttgttcaaatcttttgtccttttaaaaaaattgttttcttgagttttgagagttctttacatattccggataatctgacaaaggactcatatcgagaattcccaagaaaatgaccaacaacccaacagggcaa

SEQ ID NO: 206273 - DNA, 601 bp, Human
caacccgtggtcggcatctatccctccatgttggtctgcatattctagattctcatgtaagtcagatcttagaggacactcccttctttgtgtggcctcctgcacttggcacaattctttccagattcgcccatatgctgcaggttaccaggtgctccctttcctggctgagcagtatccccacagaagggtgcaccccagtctgttcatccatctgcttgttgatggccacgttcccaatgttcagctgccataaacatgtgtgtgcaagtctttgtgtggacaaatattttcacttctmtttggtaaatatctacatgtggaagggctagctcatgtgataattgtatgtttaacttttaagaaagtgccccgcttttccaaagcaggagtaccatttcacatttctaccaggggtgtgtgagagcccgagttcccacccccgccctcactgtgccttgggtggtcgccttccaaagggcagcctcctaggagagcatgtggtgtctcaccacggtgttcaactgcatgtgtgtcatgactgatgacgtcgactgagcatcttttcatgtgttatttgcttcaggaatctcttctttgt

SEQ ID NO: 206274 - DNA, 601 bp, Human
ctctgtcacccaggctggagtgcgatggcatgatcttggctcaccacaacctccgcctcctgggttcaagcgattctcctgtcttagcctcctgagtagctgggactataggcgtgtgccaatacacccagctaatttttgttttttagtagagatggggatttcaccatgttggccaggctggtctcgaactcctgacctcgtgatccagggcccccctcccctccccccaagtttccaaagtgctgggattacaggcgcgagccactgcgcccggctccacatccacttttttaaaaaktgtagtaaaaaacatattgacataaaatttaccatcttaatcattttaaaatgcacagttcagtggtgttaagcatattaacgttgttgtgaaaccgatctccaaaactttttcatcttgcaaatgtgaaactttgcactaattaaacaactcccatttccccccatctgcccagcccctggtaaccagcattctactttttgtttctatgcatttgactacttcaggttatcacataagcagaatcatacttctgcgactggcttatttcacttagcataatatcctcaaggttcatct

SEQ ID NO: 206275 - DNA, 601 bp, Human
cctgacctcgtgatccgcccgcctcggcctcctaaaatgctgggattacaggcctgagccaccgcgcccagcctacaacaggaagactttgttaaatgaatgagcgcgcagggaagagcaggtgctttgtgaacttgagagcttcacttcctaatcctgtgactccaacattcaattaaaggtaaagaaaaccagcaagacgaggtagggagttctgtatcctgtgtttgtttttttttttcttctttttattttttgcttttgagacagagtctcactctgtcacccaggctggagtgcratggcatgatcttggctcaccacaacctccgcctcctgggttcaagcgattctcctgtcttagcctcctgagtagctgggactataggcgtgtgccaatacacccagctaatttttgttttttagtagagatggggatttcaccatgttggccaggctggtctcgaactcctgacctcgtgatccagggcccccctcccctccccccaagtttccaaagtgctgggattacaggcgcgagccactgcgcccggctccacatccacttttttaaaaattgtagtaaaaaacatattgacat

SEQ ID NO: 206276 - DNA, 601 bp, Human
caaattttaatccttgacattcataatcacttggattaaaatctaagggaaaaaaagaatcacaggctgactttttttttttttttgagacggagtctcgctctgtcgcccaggctggagtgtggtggcgcaatctcggctcactgcaagctccgcctcccgggttcacgccattctcctgcctcagcctcccgagtagctgggaccacaggcacccgccactgcgcccgcctaatttttttgtatttttagtagagatggggtttcatttagtagagatggtgttagccaggatggtctwgatctcctgacctcgtgatccgcccgcctcggcctcctaaaatgctgggattacaggcctgagccaccgcgcccagcctacaacaggaagactttgttaaatgaatgagcgcgcagggaagagcaggtgctttgtgaacttgagagcttcacttcctaatcctgtgactccaacattcaattaaaggtaaagaaaaccagcaagacgaggtagggagttctgtatcctgtgtttgtttttttttttcttctttttattttttgcttttgagacagagtctcactctgtcacccaggctgg

SEQ ID NO: 206277 - DNA, 601 bp, Human
tttcctatagcaacactacaggggcatgagaacagggtacgcacctaaagtgaggcttgcctatactttctagaagtcttcctaaggctgctgtgctggtgtcctctgattggttgagtattttttatcattttggttttgagacagggtctcactctgttgcccaggttagggggccgtggtgcaatcatggctcactgcagcctcaaactgaagtgggctcaagtgatcctcctgcctcagcctcctgagtagctgggaccacgggcacgtgccacctatccccagctaatttctttcttttttttttttttaataaagatgggatctcactatgttgcccaggcaggtctcaaactcctaggctggagtgatcctcccatctcagcctcccaaagtgccaggattccaggcgtgtgctcccgcatccaggcagtctggtttattattcacacagaagtacatctgatattgctgaccagaggagagttgagattccgtatgaagtctatttgttcaattacctgaatcctctgagacgccccagttgcccagtattcacagtggttgtggtcgggctcagcgtttacttcacaatcca

SEQ ID NO: 206278 - DNA, 601 bp, Human
ctttcctatagcaacactacaggggcatgagaacagggtacgcacctaaagtgaggcttgcctatactttctagaagtcttcctaaggctgctgtgctggtgtcctctgattggttgagtattttttatcattttggttttgagacagggtctcactctgttgcccaggttagggggccgtggtgcaatcatggctcactgcagcctcaaactgaagtgggctcaagtgatcctcctgcctcagcctcctgagtagctgggaccacgggcacgtgccacctatccccagctaatttctttyttttttttttttttaataaagatgggatctcactatgttgcccaggcaggtctcaaactcctaggctggagtgatcctcccatctcagcctcccaaagtgccaggattccaggcgtgtgctcccgcatccaggcagtctggtttattattcacacagaagtacatctgatattgctgaccagaggagagttgagattccgtatgaagtctatttgttcaattacctgaatcctctgagacgccccagttgcccagtattcacagtggttgtggtcgggctcagcgtttacttcacaatcc

SEQ ID NO: 206279 - DNA, 601 bp, Human
tcgaaacaaaaaacaattattttaaggtctaaaatatgcagaaagagctgcagtgaacacatttacacttcccaaggacaagcatctaaggaagatccctggtaagaatgagaaagcctgggcttgtccaggaaaccaaagcttcttctaaatgtgccttccctgcacaaaatgcctcccccacaggctctgcttttcctgtcgcctggaacaagaaagctccctgggcaggcgaggccgggacctctgcactgagatccccactcagtggcctccatggctggcagagagcgagggagayggagagagaaggagctcagctgagctgttgctttagagtcttggttaaagtgaatccaattatgcacccttctttcctatagcaacactacaggggcatgagaacagggtacgcacctaaagtgaggcttgcctatactttctagaagtcttcctaaggctgctgtgctggtgtcctctgattggttgagtattttttatcattttggttttgagacagggtctcactctgttgcccaggttagggggccgtggtgcaatcatggctcactgcagcctcaaactgaagtgggctcaagtg

SEQ ID NO: 206280 - DNA, 601 bp, Human
aaacccaaaaaaggacaatccccttccggataagaccccaatgccatgaagcacagagcggcaggacgatgagaggataaatcatttggaaagaaaccacgctgcccgggtggaggagcgccagagggaagcaggccccatgtcctccctcccgcaggaagtgcaccaggcccgtcctttccacccaggctgtacaaaagggaggaggagcactcagggcggcctcccatccgccacacacccagtcagcgcggctccgaagcaggagagggccagctccgagccctgctcgtggagccaytggtgctgcggcggggagaagaggccacaggcggggacgccccagacactcccgtggggcccgtgccagggtctcctgctcctcagaaagagcccttgtgtgctactgtggtcgccaacagccccgccggccactggcccaggactcagcgtgccgttcctccaggacgcagaccggggctccctaccagccttgagtgagagaccacaagcagcctctgaagtcatcttcctctctcttctcagaagcatttctcgaatattctgctgacaagaggttagcaggacttcacaagacacc

SEQ ID NO: 206281 - DNA, 601 bp, Human
tactgtccctacctccagcccctccagaaaaaagcgaaagcggcagagaaacctgtgaaaacaagacatgccaaaaatactgactcaaaataccaaaagctctcaccctgaggtggaggggtcaacccaggcttcgtttctaggagaagttgtaagggcttcgtgttctgcactgctaggaaacaccaccctgacttagggtcgtcacagaaggtgcacatggcggggccggcgtgcacccaccactcacgccaggcgctgcgcgactgctgctggacacacacgatcccaccgaatccagacacggtatggcggttcccactttcctcactgaggaaaccaaagcttagacgttaacttggccaagggcaaaaacgctacttaactccaaagtccagcctctgaacccacccgtgtgcggggcctgaggtgtgagtagcctaactgtggactacaaaagcagttccaccacgccttctattctggagttagatccaatgacatttcctgaaaattacatttacaaacccaaaaaaggacaatccccttccggataagaccccaatgccatgaagcacagagcggcaggacgatgagagga

SEQ ID NO: 206282 - DNA, 601 bp, Human
aaaattcggcttccagctggtccagttttcccatctgtcgtatccacggaatgtccaaatgtaagggaaaaatgtggagtgtccagccgcccaccagtccacccagcaccacagcctaacctcaccgaggcctcccagcactcacacagaacactcgcagagaactgcggctccatccgcattccttaccttcattactgtccctacctccagcccctccagaaaaaagcgaaagcggcagagaaacctgtgaaaacaagacatgccaaaaatactgactcaaaataccaaaagctctcaycctgaggtggaggggtcaacccaggcttcgtttctaggagaagttgtaagggcttcgtgttctgcactgctaggaaacaccaccctgacttagggtcgtcacagaaggtgcacatggcggggccggcgtgcacccaccactcacgccaggcgctgcgcgactgctgctggacacacacgatcccaccgaatccagacacggtatggcggttcccactttcctcactgaggaaaccaaagcttagacgttaacttggccaagggcaaaaacgctacttaactccaaagtccagcctctgaa

SEQ ID NO: 206283 - DNA, 601 bp, Human
agggcacgttcccgaaccggcctctcaggacggaacccaaagacaatttcacaggatttacaatttgcagctattggttctcctttgaccgaatccttgaatttgcttaaaaaacaatgaagagttgacaagatgggccactggaaaatgaaaagagcatcggcacttcacgttcattaaaacgtgaagagatgaccaactaatgctgctttcataccctggatagtgctgagtacctaacagctctttaggtcacaacgtaaaattcggcttccagctggtccagttttcccatctgtcrtatccacggaatgtccaaatgtaagggaaaaatgtggagtgtccagccgcccaccagtccacccagcaccacagcctaacctcaccgaggcctcccagcactcacacagaacactcgcagagaactgcggctccatccgcattccttaccttcattactgtccctacctccagcccctccagaaaaaagcgaaagcggcagagaaacctgtgaaaacaagacatgccaaaaatactgactcaaaataccaaaagctctcaccctgaggtggaggggtcaacccaggcttcgtttctagga

SEQ ID NO: 206284 - DNA, 601 bp, Human
gccatgtcaggtgggccttttaaaagaggtgctctcctgctgacctagaagaaagcacacagccgtgttatgaggaggagccacgtggcaaggaagtgagggcacccctaggagctgccagctagtaagaaaatgggacatcagtcagaggactgcaaggaaatgaactctgccagtaccagtgagcttgaaaaaggatgacaagccttagatgggaacgcggccaggtgcaccagcctgcgaggttccgagcagagcacgtggcgaactctggatgcccaggctgctgacccaagcacaytgggagatcattacatctgtgccgttttaagttgctaattggtggtaatcttttcatccagcaacaaaaaacctttagtacttcttagggcaaaataaccatgaagcataaaggaaaatgtcatcttccctgcacattctcagccccagggacctcttgcacttagtacgtactgaacgcttgctgagtcaatgaagacatgtgttttttcaaacctgactttttaaatggcagcttaaatattttttcctttaatagcttagtggttctctgactcctgttcgctgtccccacatcaga

SEQ ID NO: 206285 - DNA, 601 bp, Human
gcaggcgcccgccaccatgcccggctaattttttgtagttttagtagagacagggtttcgccatgtcaggtgggccttttaaaagaggtgctctcctgctgacctagaagaaagcacacagccgtgttatgaggaggagccacgtggcaaggaagtgagggcacccctaggagctgccagctagtaagaaaatgggacatcagtcagaggactgcaaggaaatgaactctgccagtaccagtgagcttgaaaaaggatgacaagccttagatgggaacgcggccaggtgcaccagcctgcraggttccgagcagagcacgtggcgaactctggatgcccaggctgctgacccaagcacattgggagatcattacatctgtgccgttttaagttgctaattggtggtaatcttttcatccagcaacaaaaaacctttagtacttcttagggcaaaataaccatgaagcataaaggaaaatgtcatcttccctgcacattctcagccccagggacctcttgcacttagtacgtactgaacgcttgctgagtcaatgaagacatgtgttttttcaaacctgactttttaaatggcagcttaaat

SEQ ID NO: 206286 - DNA, 601 bp, Human
agaagaacaacgttttcataataccaactttcaacttgctagaaagtgacagagtttatcatcggcaaaagaaaagtaatatggatcaaccgaatagaaatgagagtgcagaaacaggcccccacatatatggccaattgatttataaaaaattgacaaggcaactcaaatgaggaaaggaaaagttttcaacaaatggtgctggaaaaactggtgatctgcacataacttaaaaaaaactctcatttggaggatcagaaaatcaaaaaaggacattgattctaactatgtcctatataartctaattcaaactggatcactaaaactagactgaaaaaaacataggatgtcaggtatggtggctcacatttataatcctacgagttcaagaccagcctgggcaatagagtgagacctcatctctgcaaaaaatttttaaaaattagtcaggtgtggtggcacacgcctatagtcccagctactcaggaggctgaggcaggaagatctcttgagcccgggaggtcgaggctgcagtgagccacaatcgtgccactgcactacagcctgagtgagaccctgtctcaaacaaacaaacaaaca

SEQ ID NO: 206287 - DNA, 601 bp, Human
ttttggtagaaattgacaagctcattttaaaatttatctcttcaaaacaccacagaataacaaaccattttataaagaagaacaacgttttcataataccaactttcaacttgctagaaagtgacagagtttatcatcggcaaaagaaaagtaatatggatcaaccgaatagaaatgagagtgcagaaacaggcccccacatatatggccaattgatttataaaaaattgacaaggcaactcaaatgaggaaaggaaaagttttcaacaaatggtgctggaaaaactggtgatctgcacakaacttaaaaaaaactctcatttggaggatcagaaaatcaaaaaaggacattgattctaactatgtcctatataaatctaattcaaactggatcactaaaactagactgaaaaaaacataggatgtcaggtatggtggctcacatttataatcctacgagttcaagaccagcctgggcaatagagtgagacctcatctctgcaaaaaatttttaaaaattagtcaggtgtggtggcacacgcctatagtcccagctactcaggaggctgaggcaggaagatctcttgagcccgggaggtcg

SEQ ID NO: 206288 - DNA, 601 bp, Human
agttcagcacattcacaagataagagattactacacaaaaatcaagtatatgttttacatactgccaataacccaatggaatctaaacattgtaaaagcaattccgtttttaatagtactaagaaacgtgaatttttttttgccgtaacttttcatcttgaaataattatagatgcataggaagttgcaaagattgcctagagaggtataggtggacctgccatgcattttccccagtggttacatctgttgttcttatagtacaatatcagaaccagggaactgacgttagtacaatgtrtgtgtggttccatgcactttgtcacctgtctagatttgtgtaaccaccactgcaatcaagagacacaactgtcccaccacaacggtctccctcgtgctaccaatttataatcacagccatcctccttcttccaccatccctaatcccttggtaaccacgaatctgatttccatctctagaatgtatagtcactgatctgttttctgttcctatagttttgccttttctagagtgtacttaaagtgaaaccatacagcatgcggctttttttttttaaaaaaagagacagggtcttactgt

SEQ ID NO: 206289 - DNA, 601 bp, Human
aagacacaatatctttaacaaaactttagcaatttaaacctaactacataaaaaatgtcaatagaagacagccactattttagcaaaataaggaagaaaaaaatacgaatgtttcaatagatgcagaaaaaaagcatgtgaaaaaattcaacacatgctcagggcttaaaaaaaaagtcctctctcaccagactaatagaaagaaacttcctcagtttgataaagggcatctatgaaaaccatgcaactaacatcctaagtcatggtggaccactgagtactttcaccctaacactgggtrtaaggcaaggatgcccacttttactgcttctggtcaatgctaagttagaaagactaacagcaaaaagcaagacagcaagcaagcgaacaaatgaaacaaaagacacagggactggaaagcaagaaataaaacaatctgcagatcgcctaactgttcaaacacaaaatcctaaggaagctataaaaaagctagcaacagaatcaatccgtgagttcagcacattcacaagataagagattactacacaaaaatcaagtatatgttttacatactgccaataacccaatggaatctaaacat

SEQ ID NO: 206290 - DNA, 601 bp, Human
aattaagaaaaagaaaaaacaaatctccagtatcaggaatgaaaaagttatactatagctccgtcaaacattgacaggtattaagagaatgttccaaacaactttatgctaacagattggacatcttatacgaaatggacaaattgctttaaaaaatttaatttcccaaaacggatactgtatgaaatagaaaatttgaacagcctttaaaagactggatttgttctaaaacaacaacaaaacttccccaaaggaaaactccaggcctagatgacctcactatcaaacacgtaaagaagamataacactaacgaacgtgaactttttcagaaaatcaaagaggaagaaataatttccaactccttttatgaggccagcatcatcctggtacccacaccgacaagattatcaaaaaagaaaaattacagaccaactctccccttgaaaagacacaatatctttaacaaaactttagcaatttaaacctaactacataaaaaatgtcaatagaagacagccactattttagcaaaataaggaagaaaaaaatacgaatgtttcaatagatgcagaaaaaaagcatgtgaaaaaattcaacaca

SEQ ID NO: 206291 - DNA, 601 bp, Human
tattagggccgggcccgggggcacacacttgtaaccccagcactttaggaggctgaggcaggtggactggttgaggtcaggagttcaagacctgggcaacatggtaaaaccccatcttctcaaaaaaaaccccaaagttagccgagtatgttggcacatgcttgtagtcccagctactcagcagggggagctgaggtgggaggatcacttcaacccagaaggccgaggctgcagtgagccaagactgcaccactgcaatccagtataggcaacagagcaagaccgtttcaaagaaaaaagaaaaaaaaaaaaaacagcttatagaagagaaaaaatgatcaaaaatcactgaccaaaggtaccacctcaaagagcttaatgaagagctctttaaactcaaggtaagcaggagaaagaaaataacaaagatgagataacaatgaaatggaaaatgaattttgcaatagaaacaattaacaaggccaaatgttggttctttaaaaatgtcaacagaactgataacctcctaagggaattaagaaaaagaaaaaacaaatctccagtatcaggaatgaaaaagttatactatagctccgtcaaa

SEQ ID NO: 206292 - DNA, 601 bp, Human
tctcacagaagagaacaaagagagtggggcagagaatgtttttagaagcagaaaactttccaaatttggtgaaagacataaatttacagatttcaagaagctccacaaattccaaatatgataagtatgaagaaactcatagcaaggatgctataccacacacttctgaataatccacaggtcaaagaagtcagactctccggtctgacatgtaaagggcctggaagtcgtcactcccatcctcacagcagcgacaccggcaaggagaacaaactgcaagtcccagctctgcttagacccmtcagagagctgagatcacaggacacactgctgcccccaaactgcagaggcagacaggcaaatgcagagaatcgcagtttaccaggaacagaagatgatgccagagcctgcaactgataggttatgcctggcttttaagaaaaaatactggagtcccctccttatcctcaggggacacatgctgagacctcagtggatgcctgaagccttgaataatacccaaccttatctatattgtttttccctttacacatgtacctatggtcaagtttaattgataagttaggcagagtaaggttaa

SEQ ID NO: 206293 - DNA, 601 bp, Human
ccgcaaacacctgcagagttttgattttgaatgaggcctttaattcctcttggtaatgcttataaattttctgtacacaggtgatgcacatcttcccttagatttattctcaggtatgtaatcttttatggtgcttcttaaatggcatctttaaacatttcccattttataatcctttgttgctagtgaatagaaatacaactgatttctgtatattggcttgtgcctagtcaccctgctaagctctgtattcattctaataatagacctgtaggttcttctcaattttccaggtgcacastcacatcacctgtgagccacaggcatggtggtgtgtggcaacaacaacattcagacagaaagcctaccatctttttggccaggagaacaagaggacagagctggggcaaccaggactgccaaggggtaaggtgggaacactccaaaaagaaaagagtcagtgagggagacctcaagttctgtgcataaactttgcctaagagcctggctggcccctgaaccgtatatatgggggcaaactgaaaggggtctctgctgtgatctaagcaaccaccagcacaggcatgaccaagttggcagt

SEQ ID NO: 206294 - DNA, 601 bp, Human
actttggtgctcaaagtgaagaaagcactgagtctcgccggccctttgcgtttccatattagttctaaagtcagctgtcaatgtctaccctccctgtccccgcaaacacctgcagagttttgattttgaatgaggcctttaattcctcttggtaatgcttataaattttctgtacacaggtgatgcacatcttcccttagatttattctcaggtatgtaatcttttatggtgcttcttaaatggcatctttaaacatttcccattttataatcctttgttgctagtgaatagaaatacaaytgatttctgtatattggcttgtgcctagtcaccctgctaagctctgtattcattctaataatagacctgtaggttcttctcaattttccaggtgcacactcacatcacctgtgagccacaggcatggtggtgtgtggcaacaacaacattcagacagaaagcctaccatctttttggccaggagaacaagaggacagagctggggcaaccaggactgccaaggggtaaggtgggaacactccaaaaagaaaagagtcagtgagggagacctcaagttctgtgcataaactttgcctaaga

SEQ ID NO: 206295 - DNA, 601 bp, Human
caaagtgctgggattacaggtgtgagccaccacgcccagcctacactgagatttttgaagaagagggctgcctcccacggcccttggggtttttgcgatgtctccagtgtttaacatgacagtttcgagatgattttccagtcagtgccactccatgcttgctggtctgtgagtgacattccactgtcaacaagagccctgctcctgtttatctcatcgctgtccacatggactcacagacgccgtcattttccaggggctgtaattcatctctgtcctcgcttactttggtgctcaaagkgaagaaagcactgagtctcgccggccctttgcgtttccatattagttctaaagtcagctgtcaatgtctaccctccctgtccccgcaaacacctgcagagttttgattttgaatgaggcctttaattcctcttggtaatgcttataaattttctgtacacaggtgatgcacatcttcccttagatttattctcaggtatgtaatcttttatggtgcttcttaaatggcatctttaaacatttcccattttataatcctttgttgctagtgaatagaaatacaactgatttctgtatattg

SEQ ID NO: 206296 - DNA, 601 bp, Human
atttttttatttttttgagatggagtctcaccctgttgcccaggctagagtgcagtggggcgatctcagctcactgcagcctccgcctcccaggttcaagagattctcctgcctcagccacccgagtagctgggattacagaggtgcaccaccatacctggctaatttttgtatttttactacagacagggttttgccccattttggccaggctggtcttgaacttaagtgatctgcccgcctcagcctcccaaagtgctgggattacaggtgtgagccaccacgcccagcctacactgasatttttgaagaagagggctgcctcccacggcccttggggtttttgcgatgtctccagtgtttaacatgacagtttcgagatgattttccagtcagtgccactccatgcttgctggtctgtgagtgacattccactgtcaacaagagccctgctcctgtttatctcatcgctgtccacatggactcacagacgccgtcattttccaggggctgtaattcatctctgtcctcgcttactttggtgctcaaagtgaagaaagcactgagtctcgccggccctttgcgtttccatattagttct

SEQ ID NO: 206297 - DNA, 601 bp, Human
atattacttacatgtagttatcatgcctctttagtttcatttaatctgaaacacttgaatttttttatttttttatttttttgagatggagtctcaccctgttgcccaggctagagtgcagtggggcgatctcagctcactgcagcctccgcctcccaggttcaagagattctcctgcctcagccacccgagtagctgggattacagaggtgcaccaccatacctggctaatttttgtatttttactacagacagggttttgccccattttggccaggctggtcttgaacttaagtgatcygcccgcctcagcctcccaaagtgctgggattacaggtgtgagccaccacgcccagcctacactgagatttttgaagaagagggctgcctcccacggcccttggggtttttgcgatgtctccagtgtttaacatgacagtttcgagatgattttccagtcagtgccactccatgcttgctggtctgtgagtgacattccactgtcaacaagagccctgctcctgtttatctcatcgctgtccacatggactcacagacgccgtcattttccaggggctgtaattcatctctgtcctcgctt

SEQ ID NO: 206298 - DNA, 601 bp, Human
caacttcagagggtatgtcctaagaatgaggacacctgcttctacaaccacggcaacttcaggtgctgcttcaggagaacgccgcaaggataagagtattcatctaggatgactgtctcataattaccacgtattagacaccgaggtttatctaatatatacagatacagcattataagaccatttccctcctctagcacagaatttagtatattacttacatgtagttatcatgcctctttagtttcatttaatctgaaacacttgaatttttttatttttttatttttttgagatggartctcaccctgttgcccaggctagagtgcagtggggcgatctcagctcactgcagcctccgcctcccaggttcaagagattctcctgcctcagccacccgagtagctgggattacagaggtgcaccaccatacctggctaatttttgtatttttactacagacagggttttgccccattttggccaggctggtcttgaacttaagtgatctgcccgcctcagcctcccaaagtgctgggattacaggtgtgagccaccacgcccagcctacactgagatttttgaagaagagggctgcctc

SEQ ID NO: 206299 - DNA, 601 bp, Human
aacctaaataacagggctgggggtggggagagctcacccagtttccagaggcttccaccacagaatctctaaaacccagcaagtgaggcaccaggcatgtcacagttggactgcctgttagctttctactttttggggaaattcacagcagaattccagcctttgtagtagccagaacccaaattccaagtctctttggggctaggacagaggtatgtgtgaaaagttgcaagaatagtacaaagagctcatacagtctttctctagattcacctgttcacatcttctctcatttgctttatccttcgctcgctctctttcaatacacagacttttaaaaatccgtcatcatttgagagcaagttgtttacccctaacaacttcagagggtatgtcctaagaatgaggacacctgcttctacaaccacggcaacttcaggtgctgcttcaggagaacgccgcaaggataagagtattcatctaggatgactgtctcataattaccacgtattagacaccgaggtttatctaatatatacagatacagcattataagaccatttccctcctctagcacagaatttagtatattacttacatg

SEQ ID NO: 206300 - DNA, 601 bp, Human
actgcactcaggcctgggcaacagagtgagacactgtctcttaaaaaaaacccaaaaacctaaataacagggctgggggtggggagagctcacccagtttccagaggcttccaccacagaatctctaaaacccagcaagtgaggcaccaggcatgtcacagttggactgcctgttagctttctactttttggggaaattcacagcagaattccagcctttgtagtagccagaacccaaattccaagtctctttggggctaggacagaggtatgtgtgaaaagttgcaagaatagtacaaasagctcatacagtctttctctagattcacctgttcacatcttctctcatttgctttatccttcgctcgctctctttcaatacacagacttttaaaaatccgtcatcatttgagagcaagttgtttacccctaacaacttcagagggtatgtcctaagaatgaggacacctgcttctacaaccacggcaacttcaggtgctgcttcaggagaacgccgcaaggataagagtattcatctaggatgactgtctcataattaccacgtattagacaccgaggtttatctaatatatacagatac

SEQ ID NO: 206301 - DNA, 601 bp, Human
tcaccattttgacatgaaccattcaatggcatttactaccttcaaaatgttgtacggccaccacttctacagcctatcagccgccactcccactgccctggcccagaccctgacaacacgaatctgctttctgtctccatggatttgccggttctggatctctcattggagcgcattcacacagcatgcagccctttgtgtctggttcttttacttggtgcggcatttccgaggctcgcccatgctgtggcacaggccagtgcaacattccattttacggccaatatatatatatgtatattacatgccattgtatggatatgtggtttgtttttccatttgtcagttgatgaacactttgtttccagtttttggccgttgtgaacagtgctacaaacagctgtgtggaagtttttgcttgaatatctgttttcatttcttgagtatacacctaggagtgaaactgtagcatcctatggtagttctttttttattttaaaatggagtctcgccccgttgctcaggctgagtgtagtggtgcgatcttggctcaccgcaacctctgcctcctggttcaagcagttctcttgcctcagcctcc

SEQ ID NO: 206302 - DNA, 601 bp, Human
ggcggaacctagaattctggcctcctcctgttttttattttgtttgtttttttgttttttgccagaatgtgaaagtacagaggagctggcccctgactctggccacgctttggcccccttgccctgtgtgtagcctcgtggctgtgcctgtggacacctcgtctccaagcctggcacacagccaccccttggtcacagcagtgagaccccaggaagagctgcacagggtccttggccgtggagcagcctctacaactgtaagctcaggctccgcagggtgtgtcctcggcgtgtgcagggktgctgtcacaggggtgccacgccgggcccctaaagcaccagcccccttgcctgggttcttcctttatgttttcattaggtaagatctacataatagaaaattcaccattttgacatgaaccattcaatggcatttactaccttcaaaatgttgtacggccaccacttctacagcctatcagccgccactcccactgccctggcccagaccctgacaacacgaatctgctttctgtctccatggatttgccggttctggatctctcattggagcgcattcacacagcatgcagccctttgt

SEQ ID NO: 206303 - DNA, 601 bp, Human
gtatcttccttttatgtaagaaatggcgggagactaaaacccatattctgcttgcttatatttggaaaaggaaacgtggatacaccagcagcagataaaaatgacttctagggagggagggaatgggggatgggacagagacaggagtagccctctctgagtatgtctgactttggaaccatgctaacatcttccataattaaaaaaaaattaaataaaaaaccaacccctcaaaattgaacccaaattaaagcaaatgaacccaataggacaataaggttagaggcggaacctagaattytggcctcctcctgttttttattttgtttgtttttttgttttttgccagaatgtgaaagtacagaggagctggcccctgactctggccacgctttggcccccttgccctgtgtgtagcctcgtggctgtgcctgtggacacctcgtctccaagcctggcacacagccaccccttggtcacagcagtgagaccccaggaagagctgcacagggtccttggccgtggagcagcctctacaactgtaagctcaggctccgcagggtgtgtcctcggcgtgtgcagggttgctgtcacaggggtg

SEQ ID NO: 206304 - DNA, 601 bp, Human
gatcgtgccactgtactccagcctgggtgacagagtgagaccctgtctcaaaaaatcgaaaaacaaaacagaacaaaaaaccaacaaaacacctcccgtgatgagtgcacacaccactcaggcagcttcttgccaaaacaccaaacacggacatgatcatgcctcgatctagaggtctgactaccacccacggggtgtgcaggggacagagaaacatcttcaataacactgcaggggtggaagagcaaagtccacatggtaagaaaccctacaggataaataatccagttactccaataamcaagttgaaagaaaaaaaggagagacatacagattaacacttaagtgatcctgaccaatggcaatgcatgaccttattaggttgttgattcaaactctgctaaaacaaagcaaaatcaacatgaaaacattaatgagacaacagggaaaatctctaaactgactaggttgacattacggaattactgccaatttttcaggagccatacggtactgcggttgtcatttttcgtcttgtctttttgaggtacactctaaaatattctctgcatttgctcccggaggccgggggagggctgct

SEQ ID NO: 206305 - DNA, 601 bp, Human
gggcaacatagtaaaaccccatatttacaagaagtaaaaacattagctgggcgtggtgcctcatgctatagtcccagctacttgggaggccgagacaggaggatcatttgaacctaggaggttgaggctacaatgagttacgatcgtgccactgtactccagcctgggtgacagagtgagaccctgtctcaaaaaatcgaaaaacaaaacagaacaaaaaaccaacaaaacacctcccgtgatgagtgcacacaccactcaggcagcttcttgccaaaacaccaaacacggacatgatcaygcctcgatctagaggtctgactaccacccacggggtgtgcaggggacagagaaacatcttcaataacactgcaggggtggaagagcaaagtccacatggtaagaaaccctacaggataaataatccagttactccaataaacaagttgaaagaaaaaaaggagagacatacagattaacacttaagtgatcctgaccaatggcaatgcatgaccttattaggttgttgattcaaactctgctaaaacaaagcaaaatcaacatgaaaacattaatgagacaacagggaaaatctctaaac

SEQ ID NO: 206306 - DNA, 601 bp, Human
ccttgagcccagaagttcaagaacagcctgggcaacatagtaaaaccccatatttacaagaagtaaaaacattagctgggcgtggtgcctcatgctatagtcccagctacttgggaggccgagacaggaggatcatttgaacctaggaggttgaggctacaatgagttacgatcgtgccactgtactccagcctgggtgacagagtgagaccctgtctcaaaaaatcgaaaaacaaaacagaacaaaaaaccaacaaaacacctcccgtgatgagtgcacacaccactcaggcagcttctygccaaaacaccaaacacggacatgatcatgcctcgatctagaggtctgactaccacccacggggtgtgcaggggacagagaaacatcttcaataacactgcaggggtggaagagcaaagtccacatggtaagaaaccctacaggataaataatccagttactccaataaacaagttgaaagaaaaaaaggagagacatacagattaacacttaagtgatcctgaccaatggcaatgcatgaccttattaggttgttgattcaaactctgctaaaacaaagcaaaatcaacatgaaaacat

SEQ ID NO: 206307 - DNA, 601 bp, Human
agaccatgaacaggatggacgtgatcccgtcgaagcactggaaccacttctggcgctgggaccgctggccgcccacatccaccatcttaaaggggatcttcttaataacgaagtcatgctccacaattcccttggtggctttcctagccagcaggatatcttgcttactaggaaagtaattctgtaaaatacaggatgaggcagaaatttagggggaggaagaaagaacagagaaaatagaaacaaaaagatggcaaaaagataagaaggaaagagactgacttttgcaacaggttgaacmagaaaccaaaagcaaatttcatttataacattatcaactggccgtgaaacagaaagaatcaaatacttcatttcaaaacgaacggaggctcaccagtctgaggacgaatgctcagaacactcgtgggcaggcccagcgcaaaaccacatccattttcttctccagaggaaatttaccatcttttttgtttccataccagagatacctttttatttttctaactcctaaagcttatagcttccaaaaccttactgtgaattaatttaggttttgaatgtgatgtaaattcaatctgcaata

SEQ ID NO: 206308 - DNA, 601 bp, Human
ccttgcaggtcacagtacccctaaaatatgtttttaaagtcaggaattcttaccatgtggagatggtttatgacaagttacagaaaattgaatatactacatatattaaagtactactttaagatcaaagcagaaagtacatgcaagtatcaaattcagaaagtgaatacaaatgtttaacattgggttttttttgagacagggtcttcttgctctgtccttcaggctggagtgcagtggtgaaaccttggctcaccgcagcctccacctcctgggctcaagtaattatcccacctcagcygcccagctgagaccacaggtgcgtgctatctatcactcctggctaatttttaaaaaatcatttgtagagacagggtctccctatgttgcctaggctggtctcgaactcctgggctccagtgattctcctgccttggcctcccaaagtgttgggatgtttacaggcataagccagagcaccaggcctagcactgtatttaccttcacaccatatcatctgatacttgcaaaaaatggctgtgaggagaacagtacaggtgatattatttcctgataaagagcagaaaaattgaggctcaga

SEQ ID NO: 206309 - DNA, 601 bp, Human
ataaaggtgaaaatccactgtttaaaaaaatcactaacatgtgaggcaaggtataggtggtggacttccctagaaatatagtaagagaatgtaaaatagtttatataaaatcaaagttatactatgtgtcagaatttctgatttatatttcatttcattcaaagcactgcaaatataccttgcaggtcacagtacccctaaaatatgtttttaaagtcaggaattcttaccatgtggagatggtttatgacaagttacagaaaattgaatatactacatatattaaagtactactttaagrtcaaagcagaaagtacatgcaagtatcaaattcagaaagtgaatacaaatgtttaacattgggttttttttgagacagggtcttcttgctctgtccttcaggctggagtgcagtggtgaaaccttggctcaccgcagcctccacctcctgggctcaagtaattatcccacctcagccgcccagctgagaccacaggtgcgtgctatctatcactcctggctaatttttaaaaaatcatttgtagagacagggtctccctatgttgcctaggctggtctcgaactcctgggctccagtgat

SEQ ID NO: 206310 - DNA, 601 bp, Human
tgtgaagttccctggaaattaaactcttacattactgccaaacagactactttgttagccttttcagtatgtataatctctttagatgctaactaaagagattccaggcccttctctcacataaaaatgctttctatttaccaattttggtgagtttttaaagaataataatagctaccacttattgcacaccttttggaagtcaagtattgaactaggcataatacaaattggttaatttgtcagagtaacccaataagccccattttacagatgaggaaacttcagttctgagctgccmtaggtcacccagttagcaagctgcagagccctaacttgaacatgaatcccttcagctccagaatccatgcttttacagtgtatctccattgcttcttcattttggctagtaatacagtatttctttctttctgaatttctttgtcaatgtcaccataaatcctctgacatttcctcaatgtatctgcacaacaggcttaacagttctgcaaaaaaaaatcaatttctctattattctagcacaagtactgtaattctataattatgttaactttgagattcagcagcaattgttttaaaa

SEQ ID NO: 206311 - DNA, 601 bp, Human
tttcagaaagcttcccaagcatccctaacattttttgaccattcaatttttcctaactcaaatatgaagccattcattgtatactatgatttgaattatgtggacagatatttactgtaataaaactatgattccaaaatttacaagcaatttttgattaatgtgaagttccctggaaattaaactcttacattactgccaaacagactactttgttagccttttcagtatgtataatctctttagatgctaactaaagagattccaggcccttctctcacataaaaatgctttctatttmccaattttggtgagtttttaaagaataataatagctaccacttattgcacaccttttggaagtcaagtattgaactaggcataatacaaattggttaatttgtcagagtaacccaataagccccattttacagatgaggaaacttcagttctgagctgccctaggtcacccagttagcaagctgcagagccctaacttgaacatgaatcccttcagctccagaatccatgcttttacagtgtatctccattgcttcttcattttggctagtaatacagtatttctttctttctgaatttc

SEQ ID NO: 206312 - DNA, 601 bp, Human
ataggagagattgagcttgtgtgggggcaacagtgaaggcaacagggaaaagggagaagttaaacacacaggatagaaagagaataacggatggaggcatatgacagggaacaaaattgtaaggactgagtattgcactcttgaacaacttttcctcttagatgggaagaaggcagtaatggatgggacacataacttcaaaagacaggaaaatgaggaaatccgtgcttgataaacttttattttccctgtgtgagaaaaaagcaatgtcacatattaagcataatggggacatgaatgrtgactatttatatagttcccatagggaaaggagatggccagggaaagtaaaaagataccggatgcgaatgtctgaggttagaaacctttgatttgcaatattatctactagcatgagtatgactttctctgggaattgagaggcaccgaaaaggccaatagtggagtaaagattgcaggaagaaaggcaaaacaatgagggggctaatatactggagaaagggaaagggggccgtggtaccacaaaagcttggactaggtagagcactgacttatgagtactagaatgagggaggtgaac

SEQ ID NO: 206313 - DNA, 601 bp, Human
ctgagatttctgggagatgtgcagtaaggcagctaaaacctaagtctagaactcagtagggagaacctagcttaaataaagatttgggagtctctttctacagataatagctgaagctgtgaaaatacataaatcatatatggagagtgcacagtatttgtagagaagtaggacaacatcagacccatggagagaacagggaaaaaagcaaaacttcaagtcactgaaactaagaaaaaatggttagagagacagagaaagaaataaaaagagcttgtagtcccaaaagccaaaggggaamcatttctaaaaggtgtggttaataaagtcaaaagtttcaaaagagatgtgggaggaaagagaacgatagactggacaatttaagaagtcatcagtggtcacagcttgagtgattccaactaagtagtgagagcaggagctgcattgcagtggactgaagaacacagaggcacaaggtggtatccagtagatgccaggtcaaattttatgttgtttttaggataggagagattgagcttgtgtgggggcaacagtgaaggcaacagggaaaagggagaagttaaacacacaggatagaaag

SEQ ID NO: 206314 - DNA, 601 bp, Human
tggtaagctagaagaaagagtacaaggttatttattgatgcctacagctgagatttctgggagatgtgcagtaaggcagctaaaacctaagtctagaactcagtagggagaacctagcttaaataaagatttgggagtctctttctacagataatagctgaagctgtgaaaatacataaatcatatatggagagtgcacagtatttgtagagaagtaggacaacatcagacccatggagagaacagggaaaaaagcaaaacttcaagtcactgaaactaagaaaaaatggttagagagacrgagaaagaaataaaaagagcttgtagtcccaaaagccaaaggggaaacatttctaaaaggtgtggttaataaagtcaaaagtttcaaaagagatgtgggaggaaagagaacgatagactggacaatttaagaagtcatcagtggtcacagcttgagtgattccaactaagtagtgagagcaggagctgcattgcagtggactgaagaacacagaggcacaaggtggtatccagtagatgccaggtcaaattttatgttgtttttaggataggagagattgagcttgtgtgggggcaacag

SEQ ID NO: 206315 - DNA, 601 bp, Human
actgggatcatgcctgtttccactcatcactatatttcagagcccagcatggggcctggtacatattaggtaattaatcaatatcgctgaataaatatcagttaaaagtacaaaccggagtgagcatgcagccaagaatgaaacttctgcaagagaccacatgaaagataatgagacctgaactaagacagtgactgtgggatacaggaggcactcataaggcaaaataaggtttggtaagctagaagaaagagtacaaggttatttattgatgcctacagctgagatttctgggagatgwgcagtaaggcagctaaaacctaagtctagaactcagtagggagaacctagcttaaataaagatttgggagtctctttctacagataatagctgaagctgtgaaaatacataaatcatatatggagagtgcacagtatttgtagagaagtaggacaacatcagacccatggagagaacagggaaaaaagcaaaacttcaagtcactgaaactaagaaaaaatggttagagagacagagaaagaaataaaaagagcttgtagtcccaaaagccaaaggggaaacatttctaaaaggtgtggt

SEQ ID NO: 206316 - DNA, 601 bp, Human
cgcccattagaaagtaagctccattagaactgggatcatgcctgtttccactcatcactatatttcagagcccagcatggggcctggtacatattaggtaattaatcaatatcgctgaataaatatcagttaaaagtacaaaccggagtgagcatgcagccaagaatgaaacttctgcaagagaccacatgaaagataatgagacctgaactaagacagtgactgtgggatacaggaggcactcataaggcaaaataaggtttggtaagctagaagaaagagtacaaggttatttattgaygcctacagctgagatttctgggagatgtgcagtaaggcagctaaaacctaagtctagaactcagtagggagaacctagcttaaataaagatttgggagtctctttctacagataatagctgaagctgtgaaaatacataaatcatatatggagagtgcacagtatttgtagagaagtaggacaacatcagacccatggagagaacagggaaaaaagcaaaacttcaagtcactgaaactaagaaaaaatggttagagagacagagaaagaaataaaaagagcttgtagtcccaaaagcca

SEQ ID NO: 206317 - DNA, 601 bp, Human
aaatggaatgcttacccaatctttacaggcaccaggcaaagtgctagacaaaaaaggacgagatgaagatggataaaataatccctaatgacaaggagctccgtggtgtgaaaagtacaggtaaataaactgttataatactgtagaataagtgccaatagcttgcactgtgggtacttgggataaacaatgagctttgttggttttttttctggggtggaatgaaatgaaggagctgtgttttgctggaaaataggtgttccctaggttcacaaagggggatgaagaggacagtacagayagaagaaacagagcgtggcaagatcaagtagcagtgaacacaaggccaggcacaggatgcacatcaggaagcgttagaaaagactagaaacattattgagtgctagaaaggactctgttttttgagctaagtagtttagatttcactttcgcacaagtggagaatgttgaggacgggaaagttcatttatgccttttagaaggattgctctctgtgacctgctaagtggtatcccaggccccttcagatccattctccatattgcaactagaatgattttctcatcatgttaccacatcc

SEQ ID NO: 206318 - DNA, 601 bp, Human
tatagtaaacagaaaacatatacagggtaaagtcaatcaaaaacatcagatcttgtattataaaatcatcacaataacattcagtcacatcatggatgagatctctgacgattaattaacgcaggacctagcattcatgaaaatttccaagtttgttcaactgaacttctatttacgtagaaaattcttagcgtaaattacctacctgttgctgggagggtgacattgtactgaagagtaacaaaaatgatagaagcttttgccgttatctacaaagaaggaaaaacaaagatcaagtcawtttgtgaccctctcccaaataacagatcggggcaaaaacattataaaatctgtccctaaatcgaagcaccaagggcctcctcgttcctgtggaatcctgacagacacaatggaaattactgattgccaaggagctaatgtaattcactagagtactcttctgcggtttaggtaaaattgtgtaattcatccttaattttaagatttcaaaagacattttctgcagttccagaaaacagttatttgacaaatgatgattctctactctagccctatacaatgaataaaaagttcctattaa

SEQ ID NO: 206319 - DNA, 601 bp, Human
ttggaaaataaggcattactttcatttctcaaacatttacaggtcccataccaggttgcaaagaacccactaatgtcaaaatccttagttgttttagttattttcaagccaatttgagttggttacttgagcaaaatgaaaatcaatgatagaaatgagatatggaatcaggtaagacataattcctggccctaaaaaatctttcaatcccatagaataaaaatacacgtacacaaacaaacataaaaccaccaataagaggcacaacagtgaccaggagagaagaattttgtcttaggtmatcagaagatttcaggaaaagtttgtagcatctgacaggagacaaaggatcagggtgctaccgagttttatggaattacgtcaataaaatactgccccaatttttttcttagataatcagatctactcagtgagaattactgcatatgtaaaaaaaaaaaaaaaaagattaaaaaataaataaaatctaaagtgatttttgtaagagtattttcccacagaagtataacttttatgtttttttaaaaaaatgtataatagtttttaaactaaaatttacatattacctataaagtattat

SEQ ID NO: 206320 - DNA, 601 bp, Human
taacaaagaaagggctgctaaaaatgacttacgtcatcaggttatggggataagccctccataagatagttgggtctgagatgtagttttcctaagaaagaagatataaaaattaacctgtgagcataatgcaaacttcttggaaaataaggcattactttcatttctcaaacatttacaggtcccataccaggttgcaaagaacccactaatgtcaaaatccttagttgttttagttattttcaagccaatttgagttggttacttgagcaaaatgaaaatcaatgatagaaatgagatrtggaatcaggtaagacataattcctggccctaaaaaatctttcaatcccatagaataaaaatacacgtacacaaacaaacataaaaccaccaataagaggcacaacagtgaccaggagagaagaattttgtcttaggtaatcagaagatttcaggaaaagtttgtagcatctgacaggagacaaaggatcagggtgctaccgagttttatggaattacgtcaataaaatactgccccaatttttttcttagataatcagatctactcagtgagaattactgcatatgtaaaaaaaaaaaa

SEQ ID NO: 206321 - DNA, 601 bp, Human
caggagctatatcataatcagtctagaaccaatactctcctcttgacattatatccctctagcccttctgcttcctctttattctccctgctccttctcctccagaagtctaaaatagaaaacacaaagccaacctaatttcttggtggtcggggtggagagaatacagtcccacataaatataatatttacaaagttcgttgaactaataaaactttagaaatcagagtatgattcagtagagtgggtattactgctagacttaaaatacccacagtcaggttattcccttctttccttygtatcttctcccttctccaattctcacatcacaatgtatttactaaatactgtgtaggtgacaagcacttgcaatgtacctggcacaatgaaggatataaaatagtttttaccgctaccaaggcacatatagtcttagtgggtatgggcacaatacaagacttacaaaaatgagacaattatagaacaatcaaaacaatatatagacactacatcaaatttctaccaaaatgacaaatttggggatacaaaagaccaatacaggctaaaatagcaaggaaaattaatatagaatagttgt

SEQ ID NO: 206322 - DNA, 601 bp, Human
gtagcacacataaaaatagtgttttatggcttttgagtaggcaaagataaactagtcaccagactggctgtcacactttcactccaggtttctcaaaggggattaaaaaaaaaaaaaagaaattttaaatgcggaaaaatgtaaacatatacacaacagacagaaaagattctgacatacccgtaactcaatcattattaataaacgatcaaacttgtttcatctatatccctcttcactttccttcacctggtattattttgaagtaaaatcccacataggatttcatatatgagaattaaaaaaaaaaaaaaaactcccagaaaaaagggaaatgaaagtacttgattaatttatccgagggaagaggtgttccaggaaaaagaagtgatgtgctgggattacaaaactagagactatcagtgtgcatgaagcataaggagtaagcagagaaagaggtccccgagaaaagatggtggcgatgggagaaactctcagggcacagttgagcagcattactctagtttaaagtaatagggagccaatacaggtttcagaagggagagggtaaagaaaacgacttttgtgatagcatggaacc

SEQ ID NO: 206323 - DNA, 601 bp, Human
aattactttgaaatgtcccttcttacttaccatagtcaatgaagaagatatagacatggattaataatgaaatccagaggtatttgttcatgagtatacaaataccttaagaaggctttaaatatctgagccatgctactaagacatcaagaaactatgatactctcagtagcgctgtccaatagaactttctgcaatcatggaaatgttccatatctcctctgttcaaaatggtacatactagccacagtagctaataagcacttgaaatgtggctactggggctaaaaaagtcaatttygtttttgttttttaagttcatgtagatgtgactagtagttagcattttggacagtacagctccacaatatctatgattcacattaggagcttactaaacatggaagggctactggaatctgggcctaacaattttatctgaagacagttctaaatcaagggtttaaaaataaaaggtcttcatcctattccttatcaatatagctggagaaacaatctactttataaaagaaatcagcataaaaagaacttaagtaccatagcatatggcctttaatttggtgctgttttctaatcctag

SEQ ID NO: 206324 - DNA, 601 bp, Human
ttaaaggtttataaggtctaatgaaggaaccagtgagacagaagatgacgtcatgatgtggaaaaaatgtcatcagattaaaaaaaagtggttctagtgatgatgaatgacagatactaacatcaaagttgcatatgaaaagtgtaatgaaactttcatgaagtaggaagggggaaaatactatttctaatactttatatgatatgcaattataggtatgtataattatatgtatgtataattaaactaaaattgaatattagaaataaaacatttggctatttcatgacttccctaaaarctcatatattcaagctgtctacgaaatattttgaatcttctcatgggcaaaatggagaactgtttatatacacagtatatgtaatttaagttttctctttgaaagaaactaagttatttgtgactaacacacctcttgaactgctactaacagcgttcctttctttcctatttgtctgtatgattggttcaaaacaatcactgtactagtttcttccagtaaagagttccaaaaataattttcatagagtaaattttaagaaactgtttaacacatatgcagctgctactttcaaattat

SEQ ID NO: 206325 - DNA, 601 bp, Human
ttgcctcagcctccccagtagccaggactacaggtgtgtgccaccatgcctggcttaccatgatttttaaaatgataaattttatctagaaaatggctactttttagtattcctgtggtaggccagcctccctcaatgttctccatttcctctggggttacagccccgatggcacggtgttcacatgtctgaggccgacaacaaagccttgcctagcaccagcacaatggtctctggacgtacacatttacatgggttgtgggggaagggagagaacagagaaggctgggtgaaatcatamcaaattataaaatcgtaaataacttcaagtgccattttcagttgttattccaacatctgtttattaaaaaatataacatacttcaaaaaatttatttttataaaaaacacatttcttgactactctatactgaaaaataaacaaagctgaatatcaaatatatgccccaaatataaggcaaagatctccccccaaaccccagatggtacatcttataattaaatctttacaaagctctgcattatagagctctgtattaattatcttgacaaataaatgtttgcgtaagacacatacacc

SEQ ID NO: 206326 - DNA, 601 bp, Human
tgtaatgtaactacttaggaggatttttttttttttaatttaaaagaaatacaagtaagtttttaaaattcacactggtcaattagcagagaacctaagctgcctactcttttcttctctgacaagactaaaaacactattataaattacaaacaaactataattcaaaaagccattccatttctgatcttttgtctttaaatttcaacccaattaggtggagcgcagttgtgcttgacattagctaaggaaaaatccatagagtttctttcctaagttcagattcaactttgtatcttakccccatacctcctttttaaaaaatagaaacatggtctcactatgttactcaggctggagtgcagtggttattcacaggtgcaattatgctgcactgtagcctccaactccagggctcaagtgatcctgctatctcagcctcctgagtaactgggactacaggcatgcaccactgtgcccagtagcctttccttttggatagtcaaccgagtcaataataatagagggtaaaatgccatcactaggttctatcttcacaaccatcaaatgcctatgcaaaagttttaaaaatagtatctat

SEQ ID NO: 206327 - DNA, 601 bp, Human
gttcctctgcagcctcactaaacttatctcttgcatttagcacagttgagtgcaggtctactggtcctccatttctctgtgtttcagtactgagagctacttcaccaaatcttttgaggagtagagattttttgaagtctagttttgaaatggaaaactcttctctagtaagcatggcgcaaagatcaagttttaggtagaacataagacagtctgaatattacaatttacagtactgtattttgggactcttaggaaaattgataccaagtttacagtcattcttccaatggaagagagmagtatctctgaaaatagacggtcttaagatcctctctacataatttgtaaatttccaatgaaatatttcagcttacaaaaggaaggagaaagggtgttgagataacatgcaaccacaagggaacctctcttctcccgttataatcatctcagaaaagctcacttagtattatcaatgcaatttgatgtacaatgcatgtagaagtgccactatatatatgccagtgtttcccagtgtggtgtgtacattggtactgaacaaaatgattgcagacagtacacaatgaaatacttttattta

SEQ ID NO: 206328 - DNA, 601 bp, Human
accaacatggcacttgtatacatatgtaacaaacctgcacattgtgcacatgtaccctaaaacttaaagtataataataataaaataataaaaaaagagtcccagttttactttttttaagacaactttgcactctttacaagttacacctctccaattctgttttcagttcaatttcaccatcaatatattttagttatctataaggctaattatctattgtttcactttcttctgagagttcacttctctatcactcctccaaaagaaaaaccatgcaacaaacaaagtaaaagttatwacagaaaagtaaacccaagaagccttcaaaattgcaagatacaatacagtatctctctagctgagaaagcctccattttagagagtaaaatacaaagtctgaattgctaaataatttcgttttatttaaagcggctactgatcgcttaaaaagttaatataatggcctaaagcatggatcttggcaatgttaggcactgactttaaatacctagtacacgagaaatagaatggctaaacaacttaccctttctgatacttttcattgctaaaataaaacaggcgggaaatgtggaaaaga

SEQ ID NO: 206329 - DNA, 601 bp, Human
ttaccgcatgactcggaaatcccactcctatgtatgtaccctagagaatgaaaacacatgtttgaacaaaaacttgcacctaaatgttcacagcatcacgattcataatagccaaaaagtaaaaggcactcaatatccatcaaatgatgaatggataaacaaaatatggtatacatccatccaaaaggttccatacaatggaatattaattggctgtaaaaataaatgaagtctttctatatgctatgacatggatgaacctcaaagcattatccatttgcaaaaccacatatcacatggktctgtttacatgaaatgtccagaaaaggccaatccttagagacagaaaatagattagagggtgccggagcagaatgaagggggcaaagtgaagtgatgctaaggggcatggggtttctttttgcagtgatagaaatattctggaattagatagtggtttgcacgattttgtgaacatacattaaaaatgactgaaatgtatactttaaagggtaaactttatgtgaattacatcccattaaagctattaaaaatattacttggagaaattaaagacaacctaaataaacagaggtatata

SEQ ID NO: 206330 - DNA, 601 bp, Human
ggaattcagcgaaagtgatgtacaatggtctccccttatttgcagtgttgctttccacggtttcagttacccacagtcaaccatggtctgaaaatagatgagtactgtataatattttgagagagaaaaataccacattcaattaacttttgctacaatatgctgttatatgtgaccaatttataaataaaactttatcatagctaattaggagaaaacatagtatatacagtcatgcatcacttaacaggctatgttttaagaaatgtgttaggcgatttcatcattgtatgaacatcayagaatgtacttccacaaatctagatggtagagcctaccacacacccaggctatatggtatagcctattgctcctaggctaaaaatctgcatggcatgttactgtatggaatactttaggcaactgtaatacagtggtaactatttatgtatctaaacatatctaaacatagaaatggtattggagaaataaagcattatcttataggaccagtgtcataaatgagtcatgtatacacatatgttgtacagctgttgactgaaatgtcattatttagcacgtaactatatagtttgaaact

SEQ ID NO: 206331 - DNA, 601 bp, Human
attacaaaaaagggctaatacaggctgatctattattacatgaacaaagatgcaaaaatcctaatgaaatactgaaaaagggaattcagcgaaagtgatgtacaatggtctccccttatttgcagtgttgctttccacggtttcagttacccacagtcaaccatggtctgaaaatagatgagtactgtataatattttgagagagaaaaataccacattcaattaacttttgctacaatatgctgttatatgtgaccaatttataaataaaactttatcatagctaattaggagaaaacayagtatatacagtcatgcatcacttaacaggctatgttttaagaaatgtgttaggcgatttcatcattgtatgaacatcacagaatgtacttccacaaatctagatggtagagcctaccacacacccaggctatatggtatagcctattgctcctaggctaaaaatctgcatggcatgttactgtatggaatactttaggcaactgtaatacagtggtaactatttatgtatctaaacatatctaaacatagaaatggtattggagaaataaagcattatcttataggaccagtgtcataa

SEQ ID NO: 206332 - DNA, 601 bp, Human
tgatggcagcggcagcccctgtggagtggctactgccatgacattggctgtagtgtgagaggtgcatccagggctgtgtgctccacatagctagcaggagccccatccctttcaaagttggagtggtgggagtcccgcactcctgggcacagtggcagccacccagctgtagttcttgggggttcaggaagccctactacctctgcaggcttggaagtgcctgctcccactgcctggccactctgctgctcctggcgtctgctagttttggagtgaaggtgagactgaccctgggattagrgcagcactgatatgcctgctcagggagcccctagatctgggggcttttctctctttcttgtcatccacaacgtggcgagcagggggacatatttcagccttgtttgtgctatagcccttttagtcccgccattcagcaggtccaaagttcccaaggcagctccctgctcccttggccctgtcaggactttgggtgctgatgagcacgagagggaggccgaggggggctgagggcagcttggtgtgggtctgtaggcaccccttggcatgaccagcctaggcaccacggatggcaggttga

SEQ ID NO: 206333 - DNA, 601 bp, Human
agaaaatgtgaacaatagtattatcttttttttcttctgagacagggtctcactctgttatcccggctggagtccagtgacatgatctccactcactgcaacctccacttctcagtgatggcagcggcagcccctgtggagtggctactgccatgacattggctgtagtgtgagaggtgcatccagggctgtgtgctccacatagctagcaggagccccatccctttcaaagttggagtggtgggagtcccgcactcctgggcacagtggcagccacccagctgtagttcttgggggttcrggaagccctactacctctgcaggcttggaagtgcctgctcccactgcctggccactctgctgctcctggcgtctgctagttttggagtgaaggtgagactgaccctgggattagagcagcactgatatgcctgctcagggagcccctagatctgggggcttttctctctttcttgtcatccacaacgtggcgagcagggggacatatttcagccttgtttgtgctatagcccttttagtcccgccattcagcaggtccaaagttcccaaggcagctccctgctcccttggccctgtcagg

SEQ ID NO: 206334 - DNA, 601 bp, Human; identical to SEQ ID NO: 34804

SEQ ID NO: 206335 - DNA, 601 bp, Human; identical to SEQ ID NO: 34803

SEQ ID NO: 206336 - DNA, 601 bp, Human; identical to SEQ ID NO: 34802

SEQ ID NO: 206337 - DNA, 601 bp, Human; identical to SEQ ID NO: 34801

SEQ ID NO: 206338 - DNA, 601 bp, Human
ggtgaaaccctgtttttactaaaaatactaaaaaattagcagggcatggtggcaggcacctgtaatcccagctactcgggaggctgaggcaggagaatcgcttgaaccgaggaggcagaggttgcagtgagttgaggatcacaccactgcaccccagcctgggcgatagagtgagactgtctcaaaaaaaacaccaaaaaaaaaaaaaaaaaaccacaccagattacaaaagataataatctccccaggcctaaagaaaagcagtacacagatacttcaagagcatatattggccctgggyaccaaaacgttgttcatacatgccgaataaagatttatttttggcaccacaaagtcaaatgtgttcttaaaaacattattttcttgatatttttctgtaggcataaatatcaaagaaaagaatcataaaattatctcagaaaaaaagaaaaccataggaagagagctgtcatgttctatgtttcaagttcacagatggatttcttactggaggttagagactttcaaatctcttgtcattcaggatatgaaattctaatctagtgtcatggccagttgaggctcagattaatcaaatatg

SEQ ID NO: 206339 - DNA, 601 bp, Human
ggatcagttggggttgggggaagacagagttagagagaaaggctttggcctgacttatgtgttgttcttactggctgtcagatgctgagaaaaatcaaactggcccaaacagagctgctgatggagtggtacgcatgggttgcacagattttctggcaccagaaaattcttttactttctacaaataggtcaggcacagtggctcatgcctgtaatcccagcactttgggaggccgaggcaggcagatcatgaggtcaggagttcgagaccagcctggccaacatggtgaaaccccttctytattaaaaatacaaaaattagctggacgtggtggcgcatgcctgtaatcccagctactcgggaggctgaggcaggagaatcgcttgaacccagaaggtggaggttgcagtgagctgagatcgcgccactgcactccagcctgggcaacagagcaagactccaaaaaaaaaaagaaaaaaaaagaaaaaacagcatctttctgcttaagtaggaatgaaaactactgaacatctactatgacaggtgtttactgaatttacatggctcatgatatcttcaacagctatgtaacctaggtat

SEQ ID NO: 206340 - DNA, 601 bp, Human
atgcagctggtgacttgaagtaaatgttcacttcccattctgaaaattctagggctcttcataagaataatgctaaatctactctgcctgtgccctgaaataacaaagactgaatgtcagcacatttgtttatagtatggtttactgactattttaagcccattgttgagatgtactgcttagaaaaagattcctttcaaaatattactgctcattggcaatggacccagtcacccaagagctgtgatgaagatgtacaaggccaaaaatgtttgttttcatgcctgctaactaacacagyatctatgctatagccatgtttcaaggtgtacttaagaaatacactttgtaagggtgtatctgccacaggcagtgattcttctgatagatctgggcaaagtacaaagaaaaatattctggaaaggaatcaccattctagatgccatgaagaacattcatgattccatgggaggaggtcaaaatatcaacattaacaggaatttggaagaagctgattctaaccctcatggatgacttggagggattcctgacttcagtggaggaagtaactctagatgcagtggaaataacaagagaactg

SEQ ID NO: 206341 - DNA, 601 bp, Human
aatcccagctactcgggaggctgaggcagaagaactgcttgaacctgggaggcagaggttgcagtgaactgagatggcgccactgaactccagcctgggtgacagagcctgactccacctcaaaaaaaaaaaaaaaaaaaaaaaagaagaagaagaagaagaaaagaaaagcaattgaaaatgaatagtgctacttcagcgaatgcatcaacaataaaaaagtgaaacagctggacgtggtgactcatgcctataatcacagcactttgggaggccaagtgggaggatctcttgagcttargagttcgagaccagcctgggccacctagtgagatcccatctctgaaaataaaaaaataaaataaaataaatataagaaagtgaaatagcctttttgctgatatgcacaaagtttcagttgtctggacagaagatcaagccagccacaagattcccttaaatgagagcctaattgagagcaaggccctctcaattctatgagaagatgcagaagaaaattctatgagaagatgcagaagatattttcaattctatgagaagatgcagaagaaaagtttaaagctagcaaaggtgagttcat

SEQ ID NO: 206342 - DNA, 601 bp, Human
acatggtgaaaccctgtctctactaaaaatacaaaaattagccaggcatggtggtgggcactgtaatcccagctactcgggaggctgaggcagaagaactgcttgaacctgggaggcagaggttgcagtgaactgagatggcgccactgaactccagcctgggtgacagagcctgactccacctcaaaaaaaaaaaaaaaaaaaaaaaagaagaagaagaagaagaaaagaaaagcaattgaaaatgaatagtgctacttcagcgaatgcatcaacaataaaaaagtgaaacagctggacrtggtgactcatgcctataatcacagcactttgggaggccaagtgggaggatctcttgagcttaagagttcgagaccagcctgggccacctagtgagatcccatctctgaaaataaaaaaataaaataaaataaatataagaaagtgaaatagcctttttgctgatatgcacaaagtttcagttgtctggacagaagatcaagccagccacaagattcccttaaatgagagcctaattgagagcaaggccctctcaattctatgagaagatgcagaagaaaattctatgagaagatgcaga

SEQ ID NO: 206343 - DNA, 601 bp, Human
ctctagatttagaatttttaaaaatccaaattatctcccattccaaatatagagtatctctagaatctggagaggatggtagatgacttcaagccagctctgctgaagatggttagaggtctctcatttaatgttaccctctccaaattccaatattgcttactgtactgggcttactactctcctatctagctctgacttgcccttttcagcctcaaatccaaccaagtgctcccatacatcttattctacagtctgacccggcacacaccacatgccactgagcactcaggctcctctrtttcctgtgtggagtgcctctcctcacgcccagccccgacttttttacctattaaaatcttacttttacagcaagacccagttcaagtttattgtcctcctcgaagcctgtgccagcttctttaataatcaacaggcttctttaataatcacattcctttccattgttccctacagttccacagctagttgtctgaaagctgattttcccccaaatgagtgaaagctccaagaaaaagaatcatgtacttactgattgctggatttcccctggcaaataaccatacgttttatatatagt

SEQ ID NO: 206344 - DNA, 601 bp, Human
gaaagtgaagtacctaaaacactaaacaaacactaaacagagtaagatcagacagtaccagagatgtcaaaggagatgaattcatatttgtttggagattagaaagtgttttgtgaaaaaaaaagcagtgtttgagataggccttgaagaatgaacagtaggaatgtaatgggaatagacagaaacaggaaaagcagtattttggatagggaggaaagaatacaaataatcacaccaaagtgaaaaagcacaagtatgtgaagtatgtgtcagcaataataagtagtctagggtaatgggctttgggtatacgtactgatgaaatgagccacaagaatacagtagtaggccaaactggtcagacccgaggtcttggtgaagcccccttgccactggaccttctactatcatccacccagattccctgtcactatacactacaaacgcagaatagctgtgatactccatcaggatggcctactaaaggtgagcagatgtcaaccagctgagaggggaaaaaaaaagaggcattcccaaacagaagacccagaaggaggaaaccacaacgtgagagcctgagccagtgtatgtcatggggaag

SEQ ID NO: 206345 - DNA, 601 bp, Human
gcttatcagaatctaagagagttaacagttcaccaccacttgttttataaagatgttaatgcactatcaggaggcaaacaaaaatattgtaaataatatttgtcacaagataggttgtaatctgtaatccttgtgcaaggatgggaatgtattcactcagttactataatacaaatgttatgttcttaaatttagggcagtattttctcctgatataaaaccattacacaaggctgaataaaggccaggaatcagaaaaatccaacaaatatttattttacataaactaagaacaaacatsatactcaaaaccgctgcaggtggctgggtgcggtggctcacgcctgtaatcccagcacttagggaggacaaggagggcagatcacctgagctcaggagttcaagaccagcctgggcaacatggcgaaaccctgtctctactaaaaatacaaaaattagccaggcatggtggtgcatgactgtagtggtgcacacctataatcccagctactcaggaggatgaggcacaagaatcgcttgaacccgggaggcagaggttgcagtgagcggagatcgtaccattgcactctggcccggaaga

SEQ ID NO: 206346 - DNA, 601 bp, Human
agaaagaggaaatagttgcatgtgtaatttattactgtataatccatatcagtctgaaaatacgtaagtctaaagtccataaaattagtcacagttccctctcccttcttctaccagtacaacagatttttaaaataggatcgttcttattgatttgtttttaaaaaaacaaacccaaaacaaacacccatgaaaaatgtactttactataatcccagctacttaagaggctgaggtgggaggatcacttgaactcagaagtttgaatcaaacctgggcaacattgcaagacctcaactgaaaaaaaaaagaaataagaaagaaagaaacagaaaaacctactttaaacctaagctaaccagtgaatgacaataataaacagtggtatttgtgctcttatatcttttgtttatttctatgtttaaactcttctccctaccacagcacaaatatttaattcatttctcaaaaattggcatcattcttcaaactaaaagaatgaattaaatgtaaacatcagctcacagaaatttaaatgtactcggcaaattcttacatgagttatttcaaaaccaatatatctaatatctgcgcagcacta

SEQ ID NO: 206347 - DNA, 601 bp, Human
acgaggtcaagagatcaagtggtggctcatgcctgtaatcccagcactttgggaggctgaggcaggtggatcacgaggtcaaaagatcgagaccattctggccaacacggtgaaaccccgtctcaactaaaaatataaaaattagctgggcatgatggcatgtgcctgtagtcccagctaatcaggaggctgacgcagaagaatcacttgaacctgggaggcagaggttgcagtgagccgagatcgcaccactgcactccaggctggtgatagaacaagactctgtctcaaaaaaaaaaaaaaaaagaaaaaagaaagaggaaatagttgcatgtgtaatttattactgtataatccatatcagtctgaaaatacgtaagtctaaagtccataaaattagtcacagttccctctcccttcttctaccagtacaacagatttttaaaataggatcgttcttattgatttgtttttaaaaaaacaaacccaaaacaaacacccatgaaaaatgtactttactataatcccagctacttaagaggctgaggtgggaggatcacttgaactcagaagtttgaatcaaacctgggcaacattgcaa

SEQ ID NO: 206348 - DNA, 601 bp, Human
tggtgattgtcaggggcagggaaacagagttgctgtttactgggaacagagttttactcatgcaagatgaaattctagagatccactgtacaacaatgtgcatatagttaacaatattgtaatttacacctaaaaattggtaagagagtcaatttactttatgtgcttatttactaccccacccacaaattcaccaaccaaaaaaaagtctccttggaaggaccaatgaaaatagttgcaagggctgggcgcggtagcttatgcctataatcccaggactttgggaggctgaggtggccgkatcacgaggtcaagagatcaagtggtggctcatgcctgtaatcccagcactttgggaggctgaggcaggtggatcacgaggtcaaaagatcgagaccattctggccaacacggtgaaaccccgtctcaactaaaaatataaaaattagctgggcatgatggcatgtgcctgtagtcccagctaatcaggaggctgacgcagaagaatcacttgaacctgggaggcagaggttgcagtgagccgagatcgcaccactgcactccaggctggtgatagaacaagactctgtctcaaaaaaaa

SEQ ID NO: 206349 - DNA, 601 bp, Human
aaaaaaaaaagtaaagtgaatttacttaatgccactgaactgcacatttaaagatggtaaattttatattatgaatatttaccacaacaaaaaaggtcaaattaaaatcaattctcaggttaaaggataattggtatttagagtctttaaatcaataagtattacaagcagaactgcaattcttgtaattttgtgaagtatcctctacagtcacattcacagaaaatctcttaacaaaatatgaaccagaatctgacatgctgataaacacacctctggagtaaaagctggactagcaatsataatctccaagtccagaactgcaggtcaactttttagcagactttgcactcatgacaacacctaagctgtaagaggctccatttcttacctataaagctgaggtgaagaacactattactgttgccccggagttattaccttacaaatctcagggatggggatgataagaggataaaaacacaagctcctacactgattaccagggataaatgactcagtaattaacaaaaggtgaacattttgtaagaagaaatgaactaaaatatttcagagtgagcagcagtaataagaggaggaa

SEQ ID NO: 206350 - DNA, 601 bp, Human
tatctcttatgtacaagacaggtaaaagggtataaaaattattaagataaggttcctccacaaaagagctgtcgtggtaatggtaatagggagttttttgtgttttgttgttgttgttttcagtttaaactacactacaagccaaaatgatgtatacatttgatctaaaagtggcacacaagctgtgcagttatgagttaaagagtaattaaggctggaggtctgcctagaagtacgatggccagaaagataagagcaggagacagcctggaaagtacaatgggaccagccagcaaagggycttgaataccatgggaaggcattttccttcgtcctgcaggcagggagactcactggaggctcaggagttacacagccaatgtatttttagaaagttaatggtgatagcagcggggatggattatagaaggtaaagaagcagagatgagttaaggtgagaaaagatgtcttaaattagagtgctgaaaataaacatgggaaaaaagggttatatagcacagaatacagtgaggaactgacagagctgactaaattggctgattgtggggaaggaagaggtaaaagagaaggtggctggaac

SEQ ID NO: 206351 - DNA, 601 bp, Human
ggcttaaataagaaatcaccactgctctgagaaccacttcgggcctaaagaaatagaggatacaggctccccaaaacgacctcagagttctgtaatgtttgctatctggtgttaactggcagtggaaaggcatctcagtgatgaatgtacgggaagcagcaccacgctgatattggcattatttattttactcttcttcctcagacaaaatttcttatttccaaaaaagacagctccaactggactctaaatctattacagatatcaaggttctaacactggaagagcagaatccaagtcygttttaaatgaacaacttttctctgctgtgtattttttctatgtgactatgttgaattggggtttccttttgtacaaaacaacagaaatgagaaacataggcaaagatgcaatttcatatctaaaattttaagtgtaaatatttgaaatctaataaattcattttctaggtggaagttcagattttacattcttttccagaacacaagttaaaacacactgcatacggtcttgtatatagctaagcactcttggccctcagattacattccttcatttttgatcaatgatgtaatgaata

SEQ ID NO: 206352 - DNA, 601 bp, Human
ggttaacagctgatagaggaaagccacctataaagcagcgctttataggtggctttataaagtgggattggccgaagggctaaaatccctggagaggctgccaaggttcttcctgtcttattcaactttgaatatccaatgactaaaataaagctgaacgccctaaagatggccaataaacgtgtagagaaagacagagggaaggatgaaggaaaggaaggggggctggttactttgtgctgtctcttctttctggctctgccaccaaccctcatttctatgaagcttgcaaggcttcacwcccaggccgctgcttcaccttaatggtggctatctggaggggtgtctctcaaggcttcgaaaggactgaaaaccatcctagtacctgaccttcatttgtcttctggggccatatcttccatgcctaggaatcctccctgctcctcacttccttttcactgacatcttgctccccaatgcattttgttccacttctcagacctgcttgcatttctctccttgtgtttttctcccatctggttatcttttccttccagtttctctctacagacacaggatctgatgtcattctaaagagact

SEQ ID NO: 206353 - DNA, 601 bp, Human
gtacaattaaacatttttaaattatcaagtgatgttttaaaaaaaggcctttacataatcttctgaagtatcatttattaattttggtagcttacttaatctcatagtattaggtactcttaatcaattttttattaggcaactgaactgagattacaaattcagagagtctttccacaaagcattaccagaacagagttctatcccttcactggggtggcagtcatgctcaagggacagccacgtaattgttctaactccagcagcagcagtggcaaccactactgattacttagaaacytaaatgctattaaatgtctcccattatagggacagggtgacactgtcattatggtagaagttgatactcttgctttttccttttttggggatcatctgaagaggttgtagaaaacgcgcagaaattagtctatcttcaaaaagtcagaatccaaacaatgtcactcactctgtaataatgcatctactgagagataatccacagggtatgtacacatatatagagacattttaagactgcccatgtttacagatccctgatgtgtaaagacaattaagaatttaggttatctttctgttt

SEQ ID NO: 206354 - DNA, 601 bp, Human
ctggtgagaacaataaattagaaactgatcctagcaaaaaatttatttttaaaaaagtacaattaaacatttttaaattatcaagtgatgttttaaaaaaaggcctttacataatcttctgaagtatcatttattaattttggtagcttacttaatctcatagtattaggtactcttaatcaattttttattaggcaactgaactgagattacaaattcagagagtctttccacaaagcattaccagaacagagttctatcccttcactggggtggcagtcatgctcaagggacagccacrtaattgttctaactccagcagcagcagtggcaaccactactgattacttagaaacctaaatgctattaaatgtctcccattatagggacagggtgacactgtcattatggtagaagttgatactcttgctttttccttttttggggatcatctgaagaggttgtagaaaacgcgcagaaattagtctatcttcaaaaagtcagaatccaaacaatgtcactcactctgtaataatgcatctactgagagataatccacagggtatgtacacatatatagagacattttaagactgcccat

SEQ ID NO: 206355 - DNA, 601 bp, Human
ccaattcctcagccggtcccttctgaggcggcaaatacctcagggtctccagccacaggattggcttggccaattattgcatgtgaccgcccccacccccttttactggaatctttttcattgccaaatagactcacagtaaaataaatgtgcactggggcatactttttaatttttttggcagttcactctctaagaatgttgatttctcctcaagatctgctcacttttctacccaccagtacaggaataggatttgtactgctacctgctgcttcatctaattttcaagggccatctygctacagtagctatgctggattttccttgagcacctccatccacaccacactctgtggggtcttcttggatgtggacagggtgtgtacctcccttaacagtccttgttgtagaggccccagtgtgcctcagacctaaggatccctatgtttcatgaatactaaatctcaaggcccatataaaacatgtcataatttatgtggtcctactgcattcttacttctttattgtcttcagtgttgcagcagtccacatgcaggagcaatgtgctgacatcccacagactgactgatctgcagcc

SEQ ID NO: 206356 - DNA, 601 bp, Human
gttcttccttgagttccaaatgtagtaatttctctgcagagcttatcataagcagactgtatctgctttatcaactctctaatatattcctgattcacctctttagattgaaaaaattgtgactgcctataaatagagatatgacttgtctggtagccttcataactcaatattggtggatttgtcagtccttgcttcatttctggctttgctgccttcccaagctcctcactgctgggtcctgtacatttgttctgtctgcaggcttggtctcattccaattcctcagccggtcccttcygaggcggcaaatacctcagggtctccagccacaggattggcttggccaattattgcatgtgaccgcccccacccccttttactggaatctttttcattgccaaatagactcacagtaaaataaatgtgcactggggcatactttttaatttttttggcagttcactctctaagaatgttgatttctcctcaagatctgctcacttttctacccaccagtacaggaataggatttgtactgctacctgctgcttcatctaattttcaagggccatcttgctacagtagctatgctggattt

SEQ ID NO: 206357 - DNA, 601 bp, Human
gtattgattagttcttccttgagttccaaatgtagtaatttctctgcagagcttatcataagcagactgtatctgctttatcaactctctaatatattcctgattcacctctttagattgaaaaaattgtgactgcctataaatagagatatgacttgtctggtagccttcataactcaatattggtggatttgtcagtccttgcttcatttctggctttgctgccttcccaagctcctcactgctgggtcctgtacatttgttctgtctgcaggcttggtctcattccaattcctcagcsggtcccttctgaggcggcaaatacctcagggtctccagccacaggattggcttggccaattattgcatgtgaccgcccccacccccttttactggaatctttttcattgccaaatagactcacagtaaaataaatgtgcactggggcatactttttaatttttttggcagttcactctctaagaatgttgatttctcctcaagatctgctcacttttctacccaccagtacaggaataggatttgtactgctacctgctgcttcatctaattttcaagggccatcttgctacagtagcta

SEQ ID NO: 206358 - DNA, 601 bp, Human
gaagacatttcttcatagaatgagaatgttttgtgaaaaagctcacagaagaaaaagatgcacacttatcaacgtatgtggtaaagtagttatttcaagaacaccaaaaaaagtttacagcataacacatacatatcaacaacttgctagaaaacaacacaaaacaacgtgacaattatttgtacttgaataaattatatcctgtttacactgcatgttatcgttgtaattaaacgtagaaatagaaaactgtaaatcaatttagcactcagaattaacctgctttcagaaccttaataatttttttttttttgtcaaaaatattttatacagtatgttgaaaatctgtaaagcctaatttatggctgagaacctagaaaacaattaggaatgatgtgggtcctcccaatcttgccattcccatgacaaagctttcacagaggggaggatgacctgtgcagttcaagctcaaactcagtcactaagaagtatgacttcaagcaagttgcttcaatttacctgtctcccgtatatcatggactgagccaaagtaaatgggatggtatgtgaaacactctttaaaaatacaaagaagtttaca

SEQ ID NO: 206359 - DNA, 601 bp, Human
agcatcataggccccagcgcatccttgtcgatgacaccctgccctgtagaggatacatctgacttctgcacttcatctatgttggcagctgctgctttctctgcaataaacataagtgtgaattaaatggcagtgctatttcaaggacagagtgacacagaaatgtttttactgtaatgatttttaaaaatctctagtgggatcagatgcagctacaaaagagttacagtacatccctgttgcccctaaatgggagaaactgctggaagcagaagccagaacattaacttttcacctctasaacctgtggcttggatccactttcaggctgcccagaaaatgaattttgaggtttcatgacagtccccaacaggcatttttttctagattatgaaactgctatattctatggcacaattaatttctactcaggagattccccaaactaggataaaggaaggtctgttgttcagaatttggtagcataatcacagatagatttgcacacatttgaagaagtaacaaggactcctaaactgctatggctgcccccatgagacattctgcaatgtctgcctggactcttttactgttccacttc

SEQ ID NO: 206360 - DNA, 601 bp, Human; identical to SEQ ID NO: 34800

SEQ ID NO: 206361 - DNA, 601 bp, Human; identical to SEQ ID NO: 34799

SEQ ID NO: 206362 - DNA, 601 bp, Human; identical to SEQ ID NO: 34798

SEQ ID NO: 206363 - DNA, 601 bp, Human; identical to SEQ ID NO: 34797

SEQ ID NO: 206364 - DNA, 601 bp, Human; identical to SEQ ID NO: 34796

SEQ ID NO: 206365 - DNA, 601 bp, Human; identical to SEQ ID NO: 34795

SEQ ID NO: 206366 - DNA, 601 bp, Human; identical to SEQ ID NO: 34794

SEQ ID NO: 206367 - DNA, 601 bp, Human; identical to SEQ ID NO: 34793

SEQ ID NO: 206368 - DNA, 601 bp, Human; identical to SEQ ID NO: 34792

SEQ ID NO: 206369 - DNA, 601 bp, Human; identical to SEQ ID NO: 34791

SEQ ID NO: 206370 - DNA, 601 bp, Human; identical to SEQ ID NO: 34790

SEQ ID NO: 206371 - DNA, 601 bp, Human; identical to SEQ ID NO: 34789

SEQ ID NO: 206372 - DNA, 601 bp, Human; identical to SEQ ID NO: 34788

SEQ ID NO: 206373 - DNA, 601 bp, Human; identical to SEQ ID NO: 34787

SEQ ID NO: 206374 - DNA, 601 bp, Human; identical to SEQ ID NO: 34786

SEQ ID NO: 206375 - DNA, 601 bp, Human; identical to SEQ ID NO: 34785

SEQ ID NO: 206376 - DNA, 601 bp, Human; identical to SEQ ID NO: 34784

SEQ ID NO: 206377 - DNA, 601 bp, Human
ctggactggcttcctgtcatctctgccatctgaaatgagaccttttcttcaagattctgaaggcttctccaagcatcctggttggatgatcttctgaaacatggcttatgatttttataccacacactacctcaatattacagttatcagcatacatatgttattttccatttaatttgtaactcctttaaaggtatgtcctaggtcatactgatttctggattcacccctcctcttcatgcactgcacagtagataatatagtaccaataaatgaaaactggtcaggcaccgactactcmaaaggaaaagattaatttctggacaggtataaaataactggctaccctaggtgctcaggactcacctgttttggctggcaaaagacgcctggtctataggcaggatgctttcaggccatggggcagtctgatttggaggagcttgttgttggctatactgaggtccccccatgttcatctctaattcagatggccctagaaagggagaagaaaaaaatcttacatctttaatcaaggaagcatttatttctgctatgtaatataaagtgaaatgtctggtttatgaaaaagggaaaacac

SEQ ID NO: 206378 - DNA, 601 bp, Human
actcaggaggctgaggcaggagaatcacttgaacccaggaggtggaggttgcagtgagccgagaccacaccactgcactccagcctgggcaacaaagtgagactctgtctcaaaacaaaaaaaccaaacaaaaatccaccaaattgtgaacttaatgcaaaaggaagtctttcatgaaagacagctattgtatttcaagagaaaacccctttaataaaaccaacagatatctttaaaaagtcatctataaatttttggctatattataaagatctcttttatataccagatgaatgaaggaaaaaaaaaaaaacccaaaaacccataatggaactaaaagtggaaattagctataaatacatgaatatgtgaatgttacagatttaagggctaaactactatctttttgaaatgtatacataaactgatgctggattcataaaacgttaaaaaacctggttcctaaatattaactgtgatgcttataaaggggatttttaaaaagcactgctcttcttttatttcaaaagagagacatggttagaaactttattacccattacttctgattttctatgacagtaagattaccataaagctg

SEQ ID NO: 206379 - DNA, 601 bp, Human; identical to SEQ ID NO: 34783

SEQ ID NO: 206380 - DNA, 601 bp, Human; identical to SEQ ID NO: 34782

SEQ ID NO: 206381 - DNA, 601 bp, Human; identical to SEQ ID NO: 34781

SEQ ID NO: 206382 - DNA, 601 bp, Human; identical to SEQ ID NO: 34780

SEQ ID NO: 206383 - DNA, 601 bp, Human; identical to SEQ ID NO: 34779

SEQ ID NO: 206384 - DNA, 601 bp, Human; identical to SEQ ID NO: 34778

SEQ ID NO: 206385 - DNA, 601 bp, Human; identical to SEQ ID NO: 34777

SEQ ID NO: 206386 - DNA, 601 bp, Human; identical to SEQ ID NO: 34776

SEQ ID NO: 206387 - DNA, 601 bp, Human; identical to SEQ ID NO: 34775

SEQ ID NO: 206388 - DNA, 601 bp, Human; identical to SEQ ID NO: 34774

SEQ ID NO: 206389 - DNA, 601 bp, Human
aagtgatccttataccagggcctccttgcaaagtgctggatgacaggcataagccaccatgcccggcgccccccccaccgaagctgcctgttccttgagcacgatgtgtagcaaggggagatggagtgagagtagcaccatagagaagggacaggattgccaccccgagctgtgtgacgttaggccagacccctcttctcctagcgaggtcaaccacacgggtgattttgggagcccgtatccgctcacacaggctgaattttagcttcataggtggaagggaatctgtgagggtgtagasatgctgggagcacctttttcctgggagagctttccaaacagggaacaaacagagccaccctgggccccgctgagagaggatcctaccagaagccctcaccactgtcttgctccacgctggtggtgacggtgatgtcatcgatgtaggtggtgggtgtcgtgtacagaagtacagaccgctgcagtccagcgtagttgaaaaagtcaaaatatgtgttctggacaaagtaacccttgggatacctaggatgggaggactgtggtttgctgggcccttgctctgggtcccctgacctcagct

SEQ ID NO: 206390 - DNA, 601 bp, Human
cgcccgccctgaaaaagatatatttttaaaaagaaaaaaaacttaaaacaaaaatttttcttaaatacagaccgagcgctgtggctcattcctgtaatcccagcattttgggagactgaggcgggtggatcccgaagtcaggagttgaaccagcctggccaacatggtgaaaccccatctctactaaaaatacaaaaattagctggacgtggtggcacacgcctgtaatcccagctgctcaggaggctgaggcaagagaattgtttgaacccgggaggcggaggttgcagtgagccaagarcacgccacagcactccagcctggacaacagagcaagactccatctcaaaaacaaaaaacaaaaacaaaaaaaacagggtatcccagctgggcacagtggctcacgcctgtaacccttgcattttggcaggccgaggagggtggatcacctgaggttaggagttcaagaccagtcaggccaatagagtgaaaccctgtctctactaaaaaaaaatagaaaaattagccgggcgtggtggcgggtgcctataatccagttactcgggaggctgaggcaggagaatcgcttgaacccgggagg

SEQ ID NO: 206391 - DNA, 601 bp, Human
tccttggcaataaattgctctatggtgcattgtctttgctgtgggattcttttttaaattcttttttattcatttattttattttatttatttatttttttcttagatagggtctcagtatgttgcccaggctggtctcaaactttgcagctaaagcgatccatccaccttggactcccaaagtgctgggatgacaggcattagccaccacacccagcctaaattcttttaaacttagaaccgcggccccacaacggctgtcaataatctcaccactgcactccagcctgggccacagtgyaagcctcatctcagaaaaagaaaaagatatatatatatttttttatttttattttttgacatggagtctcgctctgtcccctaggctggagtgcagtgatgcaatctcagctcactgcaagctctgcctcccaggttcacgccattctcctgcctcagcctcccgagtcgctgggactacaggcccctgccaccatgcccggctaattttttgcatttttagtagagacggagtttcaccatgttagtcaggatggtcgcgatctcctgacctcgtgatccccccaccttggcctcccaa

SEQ ID NO: 206392 - DNA, 601 bp, Human
gtagagatggggtttcaccatgttggccaggctggtcttgaactcttggcctcaagtgatccacccacctcagcctcccaaaatgctgagattacaggcatgagtcactctgcccaggctacaaaattttttttatttagccagacatggtggcatgtgcctgtagtcccagctactcaggaggccaaggcaggaggactgctgcaggctgagagttcaaggctgcagtgagctgtgatcaggccattgcactccagcctgggtgacagagtgagaccatctcaaaaaaaaaaaaaaaaaagaaaatgggcctcccaccaagggtgagaaacatcagaaagctcagaggaccatgcctgcccatccacctgtcttgggctcctgctgaagccagggtcaccacatgggggcaaaagacctcccttaggcatgtcccaaaccaccattacctccaatgaatacagataggcagggcgttcgtgcatcaggtacggccaccagaggctgacacctggcaccttaagttggccctgggtcccagtcccattcgccacgactttgttttctgcatccaaaagacgcacttccaacttgaacaggt

SEQ ID NO: 206393 - DNA, 601 bp, Human
atcacttcctctgcataggggtagtggctggtacggaaagcgttggcaccaagccagcgaagcaggttgaagtccttcaccagcagcggccagtcgaagcccttccctcggatctaggagatagcagagccaagtgacccctgtccctgtcgaagctgcacttcctctgagagccaggaccctggagagccaccccatgagccccctctccatttggagccatttgcctcattgccctgagctgccctcaactgcaggacacagggaaggcgaaagtggagggtgaccagaagcagccccsacaaggacccaggagccccaacacacgtccgcatcctcatgcttgttgacaccgtggaaatagaaaggtttcccattgatgaggaactggctcttggtgacagccacagtgcggatccccacagggagtgtgtagaagtcagacacaggccccagtgacgtctgtgcagtcagctgcacctatgacagccaaagcaccaggtgtgagcaccccgacagcctgagccccatccggcctgccctccagcaggaaggcccctcgtgcaccccagcagctgcctctgggcctgtaagcagagat

SEQ ID NO: 206394 - DNA, 601 bp, Human
aacatagtgaaaccccgtctctactgaaaaatgcaaaagttggccaggcgtggtagctcacgcctgtaatccgagcacttcaggaggccgaggcaggcggatcatgagttcaagagatcgagaccatcctagccaaaatggtgaaaccccgtctctgctaaaaatacaaaaattagcagggtatgttggcgtgtgcctgtaatcccaactcctcaggaggctgaggcaggagaatcacttgaacctggaaggtgaaggttgcagtgagacgagattgcgccactgcactccagcctggccrcggagtgagactccatctcataaaaaggaaaaaaggaaaacttagctgggcgtggtggcatgtgcctgtaatcccagctactcgggaggctgaggctggagaatcacttgaacctgagcggcagaggttgcagtgagctgagatcatgcccctgcactccatcctgggcaatagagggagactgcatatccaaaaaataaaaaataaagcaaaaattagctgggcgtgatgacacacatctagaatcccagctacttgggaggctgagacaggaggatcacctgagcctgggaagtcaag

SEQ ID NO: 206395 - DNA, 601 bp, Human
atcattgctctgcctatccgaaggctgtggctggcacagatcagaaaagaaccccctagcctcaagttccaaacccacactctccaacagccaggctctcagatgggaaacttcaaagcctgtgacagcctggctgaacctctccagcctgggtggctccctccaaatcctgccccagaaaacaggcatctcctctggccacctcccaaagaagcctcaaacacctgctcctggaagcctgtactcttccccttcgcaacaaagggcctgtccacccagtcctgctgagcacacccctgtrcccccaagctctgaattgtccttggcccaggctgcaacaacttctcagagccttctgcctgctgcagacttggctcagcccaaagcactgcatgaaattggggtgtgctgtatgagtcaagaggcatttctaccacctctcctgcttctaccccaagtgaaaaatccaactctgaacgctgagttagaactgcacgattgtaaggaagaaaagggggccaggtgtggtggttcacacctgtaatcccagcactttgggaaggtgaggcaggaggatcactagaggccaggagttccacgc

SEQ ID NO: 206396 - DNA, 601 bp, Human
tcctcttctctttcctcagttcatttcttcttttacgccctcccccatcattgctctgcctatccgaaggctgtggctggcacagatcagaaaagaaccccctagcctcaagttccaaacccacactctccaacagccaggctctcagatgggaaacttcaaagcctgtgacagcctggctgaacctctccagcctgggtggctccctccaaatcctgccccagaaaacaggcatctcctctggccacctcccaaagaagcctcaaacacctgctcctggaagcctgtactcttccccttygcaacaaagggcctgtccacccagtcctgctgagcacacccctgtgcccccaagctctgaattgtccttggcccaggctgcaacaacttctcagagccttctgcctgctgcagacttggctcagcccaaagcactgcatgaaattggggtgtgctgtatgagtcaagaggcatttctaccacctctcctgcttctaccccaagtgaaaaatccaactctgaacgctgagttagaactgcacgattgtaaggaagaaaagggggccaggtgtggtggttcacacctgtaatcccagcactt

SEQ ID NO: 206397 - DNA, 601 bp, Human
gcctcagcctcccaagtagctgggattacagacgcccacctctgtgttccgctaattgttttatttttagtagagacagggtttcaatatctgttggccacgccggtctcaaactcctgacctcaggtgatccacccaccttggcctcccaaagtgctgggattacaggcgtgagccaccgcacccagcctagactgttgttgaagcctgttttcctcttctctttcctcagttcatttcttcttttacgccctcccccatcattgctctgcctatccgaaggctgtggctggcacagatsagaaaagaaccccctagcctcaagttccaaacccacactctccaacagccaggctctcagatgggaaacttcaaagcctgtgacagcctggctgaacctctccagcctgggtggctccctccaaatcctgccccagaaaacaggcatctcctctggccacctcccaaagaagcctcaaacacctgctcctggaagcctgtactcttccccttcgcaacaaagggcctgtccacccagtcctgctgagcacacccctgtgcccccaagctctgaattgtccttggcccaggctgcaacaac

SEQ ID NO: 206398 - DNA, 601 bp, Human
gaggcaggcagataacctgaggttgggagttcgagaccagcctgaccaacacggagaaaccccatatctactaaaaatacaaattagctgggcgtggtggcgcatgcctgtaatcccagctactcgggaggctgaggcgggagaatcacttgaacccaggaggcagaggttgtggtgagccgagattgtgccattgcactccagcctgggcaacaagtgcaaaactccatctcaaaaaataaataaataaataagaagaaatggcccttagaagggaagaaaaacccaacagagggacccrtctgtgctcagagctcctggcacctgcccgaggcctccacagtacagactgtttttgtttttgtttttttgagagacagaatctcactctgtagcccaggctggagtgcaatgacatgatcttggctcactgcaacctccacctcctgggctcaagcaatttctcctgcctcagcctcccaagtagctgggattacagacgcccacctctgtgttccgctaattgttttatttttagtagagacagggtttcaatatctgttggccacgccggtctcaaactcctgacctcaggtgatcc

SEQ ID NO: 206399 - DNA, 601 bp, Human
ccaaaattgcaccagtgctctccagcctgggcaacaagcaagactccatcttgcggaaaaaaaaaaaaaaatttaaacttagcctgacatggccgcacacacctgtggccccagctatttgggaggctgaggcaggcagataacctgaggttgggagttcgagaccagcctgaccaacacggagaaaccccatatctactaaaaatacaaattagctgggcgtggtggcgcatgcctgtaatcccagctactcgggaggctgaggcgggagaatcacttgaacccaggaggcagaggttgyggtgagccgagattgtgccattgcactccagcctgggcaacaagtgcaaaactccatctcaaaaaataaataaataaataagaagaaatggcccttagaagggaagaaaaacccaacagagggacccatctgtgctcagagctcctggcacctgcccgaggcctccacagtacagactgtttttgtttttgtttttttgagagacagaatctcactctgtagcccaggctggagtgcaatgacatgatcttggctcactgcaacctccacctcctgggctcaagcaatttctcctgcctc

SEQ ID NO: 206400 - DNA, 601 bp, Human
actgcactccagcctggtccacagagcaagaccctgtctcaaaacaaacaaacaaaaacaaaggggaaaaaaaaaaaagcatggagccgctgctttcttccctaacttgagatgtattttacataagggcatatgatcctctagtcctagaccgagctctctaacatcactccttctacccccatctccgaatcctatacccccagaggagcagccactcttccaggtacacagagctgaggtcactaggctggacactggcaaaaatgaggttgacgccctgaaacagctcttgaacacmggaggtggatggatgcagatttgggagggatatttattaatgcatcaagcaaacggagtgcaggctgggaggcaggcatggggctaggtgcgaggtgctcagcagtgactcaaatctaagtccacaggtcctgggcagtgggagtggagacgcatgcagagaaatggtgcaagtgccgggcaaggcggctcacgcctagaatcccagcactttgggagttttaccagagaccaggagttcaagaccagcctgggcaacatagcaagaccttgtttctacaacaaatttaaaaattagggg

SEQ ID NO: 206401 - DNA, 601 bp, Human
tgttcccatgaccaggcttcaggacaagcccaggcaaaggcagggagaagtggggtggggacccccaggctcacccccttgtctgctgcatagttagagttgctcacaaaggtcacaggccgggaggggtccaaggatttggtgtgagcgatcaccatcctgtccacaaaaggcagaagaaacaggttccatcagtccaggaatggctcagacaccctcccatcctctctgtcccatcttccaccgccagaacacaacacggggccaggcacgatggttcacacctgtaatcccagcactytgggaggccgaggtgggtggatcacttgaggtcaggagttcaagatcagcctggccaacatggtgaaaccccaactctatctactacaaatacaaaaattagcggccaggcgcagtggctcacgcctgtaatcccagcactttgggaggccgaggcgggcagatcacaaggtcaggagatcgataccatcctaacacggtgaaaccccgtctctactaaaaatacaaaaaattagccgggcgtggtggccggcgcctatagtctgagctactcaggaggctgaggcagaagaatggcgtg

SEQ ID NO: 206402 - DNA, 601 bp, Human
cagtgacccaaccacaaggccccctcttcccggccacctccttttcttcctggtagggtgtgttgttgccaagacaatggggtccatggctcctctctcctgccccaccttgaggccagccaggccaaggcagggcagggattccatggaggggggctggggtgcagctgtctgctggtgtctgggtgggggccagagaagtgagcacagtcgcagctggtgccatcctccagctgcaccttatctgtccctggcagtgggagcagctgatgtggccagaatgctgagcagcagcaagggragggggctggcagatggtcacccagtctgccctatgccaccccctcctccgctgagacctagaccctttgcctagcggagagagaagcaggaattcatttctggggcctggaagagaaggaagaggaggacagagtggaaatgctggggtggacatgtggtgtgactcataatctctctcaggagggtgaaattgggggacaggaatccctgggaggggtccacaggagtccttctcaggaccctggattggagaccagaatctcccagggaagaggtggagtgaatggggatgagcaca

SEQ ID NO: 206403 - DNA, 601 bp, Human
cttcctagctcctctctcaccctcagcggatgaccttggctaccacttacttcactgagaaaatagaagcctcagacaagatcttgtccttcttctgggtaccaagccctagaagggaacattcatcttatctaggataaagtctcaacctagaattttcatcttattccctctgcctttttaagatctttctcctgctaattctgtctctccctgctctacagttggtcgctctttctcaagtgaaaccccattgacaatgaaacatgctgaagatgctcttgtcttaaaatacatagcygtaacgacagctaacatatattgagaacttgctatgtatcggtctttgtgctaagataaaaactaaaacatatgtgtctctcaactccacagcacctgccagctcctatagtatctctctgcttccctttacaaagttcctaaaagtgatatgtttatttcactgtttctatttcctcatctctaactcactttctgatccactccaggctgccttcttcccccatcatcaccattcctcctaaatggttctagctaaggccagtggtcaccttcatgttgccgaatccagcaaatattt

SEQ ID NO: 206404 - DNA, 601 bp, Human
aaaacatatgtgtctctcaactccacagcacctgccagctcctatagtatctctctgcttccctttacaaagttcctaaaagtgatatgtttatttcactgtttctatttcctcatctctaactcactttctgatccactccaggctgccttcttcccccatcatcaccattcctcctaaatggttctagctaaggccagtggtcaccttcatgttgccgaatccagcaaatattttttttattattcttgatctctcaatagcatttaaaatagttgcccaccaactcttctgttgttgttttttttttttttttgagacggagttttgctcttgttgctcaggctggagtgcagtggcaccatctcagctcactgcaacctccgcctcctgggttcaagcaattctcctgcctcagcctcctgagtagctggattacagatgcgtgccaccatgcgcggctatttttttgttgttgttgtatttttcgtagagacgggttttctccatgttggtcaggctggtcttgagctcccgacctcaggtgatccgcctgtctcggcctcccggagtgctgggattacaggcgtgagccactgcg

SEQ ID NO: 206405 - DNA, 601 bp, Human
ccatcatcaccattcctcctaaatggttctagctaaggccagtggtcaccttcatgttgccgaatccagcaaatattttttttattattcttgatctctcaatagcatttaaaatagttgcccaccaactcttctgttgttgttttttttttttttttgagacggagttttgctcttgttgctcaggctggagtgcagtggcaccatctcagctcactgcaacctccgcctcctgggttcaagcaattctcctgcctcagcctcctgagtagctggattacagatgcgtgccaccatgcgyggctatttttttgttgttgttgtatttttcgtagagacgggttttctccatgttggtcaggctggtcttgagctcccgacctcaggtgatccgcctgtctcggcctcccggagtgctgggattacaggcgtgagccactgcgcccggaccccaccacctcttttttgaactattcgctttcctgacaatcatactctctttgttttcctcctatgtctacccactcctctgtctctttgccagttcattttcttctacttggccatttagtgtcatcactactcaaggctcagtctcaag

SEQ ID NO: 206406 - DNA, 601 bp, Human
ttttttttttttgagacggagttttgctcttgttgctcaggctggagtgcagtggcaccatctcagctcactgcaacctccgcctcctgggttcaagcaattctcctgcctcagcctcctgagtagctggattacagatgcgtgccaccatgcgcggctatttttttgttgttgttgtatttttcgtagagacgggttttctccatgttggtcaggctggtcttgagctcccgacctcaggtgatccgcctgtctcggcctcccggagtgctgggattacaggcgtgagccactgcgcccsgaccccaccacctcttttttgaactattcgctttcctgacaatcatactctctttgttttcctcctatgtctacccactcctctgtctctttgccagttcattttcttctacttggccatttagtgtcatcactactcaaggctcagtctcaagctttaatcttcttttaaatcataagagtacaatgcaccagcttgaaaaatttttacactggtatgtcttacagtgtagtattttgcatattgcattggtataaaacatttccagtaccccagaaagttccttcaggctgtttccta

SEQ ID NO: 206407 - DNA, 601 bp, Human
atttttcgtagagacgggttttctccatgttggtcaggctggtcttgagctcccgacctcaggtgatccgcctgtctcggcctcccggagtgctgggattacaggcgtgagccactgcgcccggaccccaccacctcttttttgaactattcgctttcctgacaatcatactctctttgttttcctcctatgtctacccactcctctgtctctttgccagttcattttcttctacttggccatttagtgtcatcactactcaaggctcagtctcaagctttaatcttcttttaaatcatamgagtacaatgcaccagcttgaaaaatttttacactggtatgtcttacagtgtagtattttgcatattgcattggtataaaacatttccagtaccccagaaagttccttcaggctgtttcctagtcaatgctaccccataagagttaaccactgttctaacagtatagatcaatttccctcattcttgaacttcttggagtatatgtatcctccatacagtgtatactcttttgtgtctgtttgttttgttttgttttgcttgtgattacgtctgtgagatttagccatgttgttgtgtgt

SEQ ID NO: 206408 - DNA, 601 bp, Human
cagcccagctctctcctcttagcatcagctccagtcgccaattttcccacttaacgtctctacttggatgtccctaagactcctcaaaacctgcatgtgcaaaaccaaagtcatcatcttacctcccaaactagttctttacctgtgtgcctgatctagtgagccacccactgttcaccccgtcatgcaaaccagaaatcatccctgacactccatctccctcacctgccttgacaggatctgccaattttgcctcataaacatctccactctaccccctgttccggcccatcccaccacygcatgtctctttgggccacggcaatggctcctcgacaggccttccagcagcccttctatatccttcactctgcagccagagtggtcttttcaaatcaaagctctgatcacttgaacgccttccatggggagtctttcattgtccctcagccagaatcctcaccgtggcctttaaggccctgagtgacctgggtcctccctgcctttacccacctctccagccacacttgccccttctcatctctctccttccaggcctttgcatacactctgttctctctctggaatatcctccctcctc

SEQ ID NO: 206409 - DNA, 601 bp, Human
tccatggggagtctttcattgtccctcagccagaatcctcaccgtggcctttaaggccctgagtgacctgggtcctccctgcctttacccacctctccagccacacttgccccttctcatctctctccttccaggcctttgcatacactctgttctctctctggaatatcctccctcctccacagcggtaagcgctagtgcgcacgtgcacacacacaaatatatacacacacacaccattacctaattactcctctttatttattttttattttatttatttatttatttatttatttatttatttattatttaatttatttttttgagacagaatctcgttctattgcctgggctggagtgcagtggtgcaatcttagctcactgcaacttccacatccttggttcaagcaagtctcatgcctcagcctcccaagtagctgagattacagtcatgtgtcaccatgcctggctaatttttgtatttttagtagataaggggtttcaccatggtggccaggctggtcttgaactcctggcctcaagtgatccgcccatttcagcctcccaaagtgctgggattacaggcataagccaccgc

SEQ ID NO: 206410 - DNA, 601 bp, Human
ttatttattttttattttatttatttatttatttatttatttatttatttattatttaatttatttttttgagacagaatctcgttctattgcctgggctggagtgcagtggtgcaatcttagctcactgcaacttccacatccttggttcaagcaagtctcatgcctcagcctcccaagtagctgagattacagtcatgtgtcaccatgcctggctaatttttgtatttttagtagataaggggtttcaccatggtggccaggctggtcttgaactcctggcctcaagtgatccgcccayttcagcctcccaaagtgctgggattacaggcataagccaccgcgcccagcctcctctttattctttagactgtaattcaaacatcatttcctcagagaaagcttccttaattccccagtctggggcaagtccctctgtcattcactctgatagagtcatttttttttttcatagcacttatggtttgcaattagatatttgtttttttcatttttgaattgaggtctgtcttccctgttcgacagtaagctccatgagggcaggtccatgatgtgttctccactgtgtcaatgagtaaat

SEQ ID NO: 206411 - DNA, 601 bp, Human
ggggtgtgtgtgtgttggggcgtgtgtgtgtgtgttggggtgtgtgtgtcgccccacaccagggctgcgtgtctgtgtggtaatgtgcaagtgtgcagtgtggtcttggttgctgtgggggaagaggtattcagttgcacccaacttactgtcctttggcactgtctgtgcgtgcacacccttgtctttgctggggctcccaagctggaagctcccgctgccttagctgcttccttctggaaatcaatctacttccccttccaaaacatctgaaggagggggacagtgccctctagtgggracgcatgggcagctgcagcttcctcagcccaagcctcagccccactccacccaagtctggaagtcctctctgaagcacttcctggggaatgcaaaggaggaggcccctgccctctgagagctcaagatctggcaggcaggaaaaagatacacacaggacaggacacacaggttcatgcaggagaagcctgaggacagcagctgaaggtgggggagtctctcctcatctctgcaatgacttatctctggttgccctgggtgttcctggccttccttgcttcctgttcctgcacatggtctc

SEQ ID NO: 206412 - DNA, 601 bp, Human
tttttttttttttgagacggagtcttgctctgtcccccaggctggagtgcagtggctcagtctcggctcactgcaagctccacctcctgggttcacaccattctcctgcctcagcctcccgagtagctgggaccacaggcgcctgccagcacacctggctaaatttttttggttttttttttttgtatttttagtagagacagggtttcactgtgttagccaggatggtctcgatctcctgacctcttgatctgtccacctcgacctcccaaagtgctgggattacaggcgtgagccaccrcgcctggctgctttcagctttgtggggctacaagagaggactaaattttgccaggaggcagtggggagtgagagaaggtctttacttttttgagatggagccttgttctgtcgcccaggctggagtgcagtggtgcgatctcggctcactgcaacctccgcctcccgggttcaagcgattcttctgcctcaacctcccaagcagctggaactacaggtgcgtgccaccatacctggctagagaaggtctttaagcagaagaatggtcagagtcacacaactcgaactaaaggtggggaga

SEQ ID NO: 206413 - DNA, 601 bp, Human
ggcaccaggaagcccctggagaaaatgcccatccagatcttctgctccatgtcattctcctctggagaggaagccccagggcccttgggagatatttggggtccccaccaccatcagcagcagcaggacatctcagaatcggaagaggaggaagaagagaaggaaaaggaggcagtgaggaaggaggccagtgaggggcattcacccatggacttggtggcctttgccaacagctgcaccctccatggcaccaaccacatttttgtggaggggggtccagggccaaggcaggtgctgtggkcggtggcctttgtcctggcactgggtgccttcctgtgccaggtaggggaccgcgttgcttattacctcagctacccacacgtgacccttctaaacgaagtggccaccacggagctggccttcccggcagtcaccctctgcaacactaatgctgtgcggctgtcccagctcagctaccctgacttgctttatttggcccccatgctgggactggatgaaagtgatgaccccggggtgcccctcgctccaccgggccctgaggccttctctggggagccctttaacctgcaccgcttctaca

SEQ ID NO: 206414 - DNA, 601 bp, Human
ggacatctcagaatcggaagaggaggaagaagagaaggaaaaggaggcagtgaggaaggaggccagtgaggggcattcacccatggacttggtggcctttgccaacagctgcaccctccatggcaccaaccacatttttgtggaggggggtccagggccaaggcaggtgctgtggtcggtggcctttgtcctggcactgggtgccttcctgtgccaggtaggggaccgcgttgcttattacctcagctacccacacgtgacccttctaaacgaagtggccaccacggagctggccttcccrgcagtcaccctctgcaacactaatgctgtgcggctgtcccagctcagctaccctgacttgctttatttggcccccatgctgggactggatgaaagtgatgaccccggggtgcccctcgctccaccgggccctgaggccttctctggggagccctttaacctgcaccgcttctacaatcgctcctgccaccggctggaggacatgctgctctattgctcctaccaagggggaccctgcggccctcacaacttctcagtggtgagtggagccccatgcctgccacagtaccccaagagtgtc

SEQ ID NO: 206415 - DNA, 601 bp, Human; identical to SEQ ID NO: 206402

SEQ ID NO: 206416 - DNA, 601 bp, Human; identical to SEQ ID NO: 206403

SEQ ID NO: 206417 - DNA, 601 bp, Human; identical to SEQ ID NO: 206404

SEQ ID NO: 206418 - DNA, 601 bp, Human; identical to SEQ ID NO: 206405

SEQ ID NO: 206419 - DNA, 601 bp, Human; identical to SEQ ID NO: 206406

SEQ ID NO: 206420 - DNA, 601 bp, Human; identical to SEQ ID NO: 206407

SEQ ID NO: 206421 - DNA, 601 bp, Human; identical to SEQ ID NO: 206408

SEQ ID NO: 206422 - DNA, 601 bp, Human; identical to SEQ ID NO: 206409

SEQ ID NO: 206423 - DNA, 601 bp, Human; identical to SEQ ID NO: 206410

SEQ ID NO: 206424 - DNA, 601 bp, Human; identical to SEQ ID NO: 206411

SEQ ID NO: 206425 - DNA, 601 bp, Human; identical to SEQ ID NO: 206412

SEQ ID NO: 206426 - DNA, 601 bp, Human; identical to SEQ ID NO: 206413

SEQ ID NO: 206427 - DNA, 601 bp, Human; identical to SEQ ID NO: 206414

SEQ ID NO: 206428 - DNA, 601 bp, Human
gccgggcacggtggctcacgcctacaatcccagcactttggaaggccaaggcaggctgatcacaaggtcaggagatcgagaccatcctggctaacatggtgaaaccccgtttctactaaaaatacaaaaaaaaattagctgggtgtggtgacgggcgcctgtagtcccagctacttgggaggctgaggcaggagaatggcgtgaacctgggaggcggagcttgcagtgagccgagattgcgccactgcactccagcctaggcgacagagtgagactccatctcaaaaaaaaaaaaaaaaaagaaagaaattatttgatgctaggtgctctgaggagccctataggctaccatggagaggagggaagtagaggggatcagctctgacttcatctctgctgggcttctatgcaagtgctcacagagatcaagtgagaggcacaaagtcaaactggcagcaagtttgcaaagccaactatcttctgacaaggcagaggaccctacctctcccacatcaatgttttgttgatgcccatcatcctcacatcctcctccctcagcatttccatccctctcttgccctcttccccaacacacttacca

SEQ ID NO: 206429 - DNA, 601 bp, Human
cttacagggtgtcagactgaaaaaggaccttagaaattatttgacaaggccgggcacggtggctcacgcctacaatcccagcactttggaaggccaaggcaggctgatcacaaggtcaggagatcgagaccatcctggctaacatggtgaaaccccgtttctactaaaaatacaaaaaaaaattagctgggtgtggtgacgggcgcctgtagtcccagctacttgggaggctgaggcaggagaatggcgtgaacctgggaggcggagcttgcagtgagccgagattgcgccactgcactcyagcctaggcgacagagtgagactccatctcaaaaaaaaaaaaaaaaaagaaagaaattatttgatgctaggtgctctgaggagccctataggctaccatggagaggagggaagtagaggggatcagctctgacttcatctctgctgggcttctatgcaagtgctcacagagatcaagtgagaggcacaaagtcaaactggcagcaagtttgcaaagccaactatcttctgacaaggcagaggaccctacctctcccacatcaatgttttgttgatgcccatcatcctcacatcctcctcc

SEQ ID NO: 206430 - DNA, 601 bp, Human
agatttctggtacaaagatgccttctttttctgattggacataaatggggaaaagtgtaatcttaggaatgctggcagccattaagtggcccagacttaaatggtcctacagaagatgcaacagtgagaaaaaagtcagtccggtatttagagacatactgaactactgggtcaagtcttcacctggagccagcactacctatggactttctagttacatgaaccaataaatcctttttattttaagccagtttgaattaggttttctgtgatttaaaaccaaaagatccctaacctatayattcatcatacttagcccattcctaccttcccacaggatagcacagggaatacaggtaaggtcactacagatttattggttacactaaagcccagggtatcaagctgaaaaggtcagaggcagcaaccaggtactaagtagactgggtgactcagctgtctgtacagaggagaatggacttccttaggaaaagaatagccaaatgagaagcaagtgcaaagaagggcctctactaggcaaagttaacgtagggatataaacactcttccccacagacctgtatcatgggggtgttgcttt

SEQ ID NO: 206431 - DNA, 601 bp, Human
acatttcattttccttttctcagcctagttctgcatttactcatctacagagggaaataatgacggaacctgtcctacacgatgacgatgaggaagactccaaagttcctagacccctattaaaaatatatattttttgaaatacagactcacaggggatttcaaaaacagtacctggagtctcatggacccttcagccaacttccccatggtgacgtcttcatatccgtgggacaatatcagaaccatgtcatcgatgttggtatatccttattaaagagaacacatacctcgttcagcttttttttttttttttttttgagacagggtctcactctgttgcccagtctggagtgcagtggtgcgatctcggctcactccagccttgaactcctgggctcaagcaatcctcctgccttggcctcccaaagtgctgggactatatacaggcatgagccatcgtgcccggcttgttcaggctttattagttttcaaaaggtgctcatttgtgtttgcgagtgtgtgtgtagagttctgtgcagttttacccagtgtgtggatttggcagctaccaccctccaaaccatggtgcaggatgaat

SEQ ID NO: 206432 - DNA, 601 bp, Human
cagctactagggaggctgaggcaggaggattgcttgagcccaggaggtggagactgcactgagccatgatggtgccactgtgttccagcctgggcaacagagcaagaccctatgtcaaaaataaagaaagtatcaagggagatgagtacacagtgcctggcacactgtagggtctccaaaaagtaaaccttttctatccatcagtttcctcttctctccagcatgaaatcgcatatgtaaagttgaaaaaaagagtgagagatatatcttaaaaaggtagtaatgttgatgacattgtggttttttttttttttttaaagaaaaaccggccgggtgcggtggctcatgcctgtaatcccagcactttgggaggctgaggcaggcgggtcatgaagtgtcaggagatcgagaccatcctggctaacacggtgaaaccccgtctctactaaaaatacaaaaaaaaattagccgggtgtggtggcgggcgcctgttagtcccagctgctggggaggctgaggcagcggaatggcatgaacccgggaggtggagcttgcagtgagccgagatcacaccactgcactccagcctgggcgacagagc

SEQ ID NO: 206433 - DNA, 601 bp, Human
gctgcatttcttgggtgggcatgttttcccggcgtctccgattctgtgctgtgttgggtgagacaggatgatggacattttgcttccccattaggatcttaagtgaaagtccagttggcatttgcatttgatctgagtaggagaaaacatgataaatagccattagaggccgggtgtgggggctcacacctgtaattccagcaatttgggggccgaggtgggcagatcacttgagatcaggagttcgaaaccagccttgccaacatgacgaaaccccgtttgtacccaaaaatacaaaaaytagctgggcaccgtagtgggtgcctgtcatcccagctactcaggaggctgaggcaggagaatcacttgaacccgggagatagaggttgcagtgagccgagtctgtgccactgcactccaacctggggtgatagagtgagactccatctcaaaaaaaaaaaaaaaaaaacaaccaaaaaaacccaaaaacacattagatgcatttgaagcctcccagcaattctcccatgatggcagaataggcatccaggagactcaccctaccctgtctgaacacctttagcgaagatgtaaatgatct

SEQ ID NO: 206434 - DNA, 601 bp, Human
gggtgggcatgttttcccggcgtctccgattctgtgctgtgttgggtgagacaggatgatggacattttgcttccccattaggatcttaagtgaaagtccagttggcatttgcatttgatctgagtaggagaaaacatgataaatagccattagaggccgggtgtgggggctcacacctgtaattccagcaatttgggggccgaggtgggcagatcacttgagatcaggagttcgaaaccagccttgccaacatgacgaaaccccgtttgtacccaaaaatacaaaaattagctgggcacsgtagtgggtgcctgtcatcccagctactcaggaggctgaggcaggagaatcacttgaacccgggagatagaggttgcagtgagccgagtctgtgccactgcactccaacctggggtgatagagtgagactccatctcaaaaaaaaaaaaaaaaaaacaaccaaaaaaacccaaaaacacattagatgcatttgaagcctcccagcaattctcccatgatggcagaataggcatccaggagactcaccctaccctgtctgaacacctttagcgaagatgtaaatgatctgcagaggatact

SEQ ID NO: 206435 - DNA, 601 bp, Human
actgtgcctggccaactaccttgttttttttggatgaaaatgtggttcttacctcagtaaagattatgaagggatttatgtacagatgactaaaatatcagccattagtttcctatttgtttttgttgttgtcattttttgttttgagacagggtcttgctctgttgcccaggctggagtgcagtgatgcgatcttagctcactgcagcctcgacctcccaggctcaggcaatcctcccacctcagcctcccaagtagttgggacgacggctgtgcaccaccacacctgggtaattttttrtttttatttttgtagctgggatctcgctatgttgcccaggcaggtcttgaactcccggcctcaagtgatcccaccatctaggcctcccaaagtgctggacttacaagcgtgagccaccctgcccagcctagtttacaatttgaacttggtttttcatctcggctcctttgaagacttctgtcttctcccatgtttggggcggctctgcgttgtggacattccttagtgatcggcctgggaaggctcagacatgtctaggctgcctttgtaggaatagggattagtagctccttagcccca

SEQ ID NO: 206436 - DNA, 601 bp, Human
ggttcttacctcagtaaagattatgaagggatttatgtacagatgactaaaatatcagccattagtttcctatttgtttttgttgttgtcattttttgttttgagacagggtcttgctctgttgcccaggctggagtgcagtgatgcgatcttagctcactgcagcctcgacctcccaggctcaggcaatcctcccacctcagcctcccaagtagttgggacgacggctgtgcaccaccacacctgggtaattttttatttttatttttgtagctgggatctcgctatgttgcccaggcargtcttgaactcccggcctcaagtgatcccaccatctaggcctcccaaagtgctggacttacaagcgtgagccaccctgcccagcctagtttacaatttgaacttggtttttcatctcggctcctttgaagacttctgtcttctcccatgtttggggcggctctgcgttgtggacattccttagtgatcggcctgggaaggctcagacatgtctaggctgcctttgtaggaatagggattagtagctccttagccccactctttcctgggatgttgctgtttgctgaggtctgcacagttc

SEQ ID NO: 206437 - DNA, 601 bp, Human; identical to SEQ ID NO: 31779

SEQ ID NO: 206438 - DNA, 601 bp, Human; identical to SEQ ID NO: 31778

SEQ ID NO: 206439 - DNA, 601 bp, Human; identical to SEQ ID NO: 31777

SEQ ID NO: 206440 - DNA, 601 bp, Human; identical to SEQ ID NO: 31776

SEQ ID NO: 206441 - DNA, 601 bp, Human; identical to SEQ ID NO: 31775

SEQ ID NO: 206442 - DNA, 601 bp, Human; identical to SEQ ID NO: 31774

SEQ ID NO: 206443 - DNA, 601 bp, Human
ctctcatgttttggaatggttcgctcactttttttttttttttttttttgagatggagttttgctcttgttgcccaggctggagtgcaatggcgtgatcttggctcaccgcaacctttgcctcccaggttcaagcgagtctcctgcctcagcctcctgagtagctgggattacaggcatgtgccaccatgcccagctaattttgtatttttagtagagacgaggtttctccatgttagtcaggctggtctggaactccccaacctcaggtgatccgcccgcctcggccacccaaagtgctrggataacaggcgtgagccaccgtgcccggctcaccctttctttttagacactgactttttgaaaagaccaggccatttgtctttgagaacatcccacattctgtgtttgtgttaagatttcctcatgaaaaccttactatgttcctctatattgtattgctgtatttcctaggaactggaagataagtctgaaggcttgtttagattcagattaggctggatatggtggctcatgcctgtaatcccagcactttgggaggccacggcgggaggatcacttgaggccaggagttcaagact

SEQ ID NO: 206444 - DNA, 601 bp, Human
agcgtgggcaacagagtgagactccgtctccaaaaaagagtagaaagatactggcacattactagaatcccactgagtcattaattaataattagtctagtccatgatcatgtcatgtaaaaatgtctcctagggtgaggccattcaggtttgcaggcttctattcaatcttgttaggttccaaaaccaggagtgttctcggcaaacatagcttcatactttcaggcatctgggataattgtgctaagagacaatatcatctcttgctctgaacctcttttgaggtgttaatgtaatactkagtttccctcattacataactcatttattcatttctttacctcccttctcttacccaaacttttccacctttcaaagggacgttaggattggccactgtgctgatctggagtgcacacagcaagctagtctgcaattgcctcctcctcagtccatacagtctcattcagatagggtagggttgcatgggtacagaactagtgggctgtcttttttgtttgttttgagacagggtctcattatgttgcccaggctggtcttgaactcctgggcttaagctgtcctcccattgcaacctccc

SEQ ID NO: 206445 - DNA, 601 bp, Human; identical to SEQ ID NO: 20569

SEQ ID NO: 206446 - DNA, 601 bp, Human
tggacttgatctccacctcacctcagccccagtgcagacctcaacttggaccccagcttactctgcagcttcttcatgactctgactccgactccctccagtttcttctttttctttttcttttttttgagacggagtctccctctgttgcccaggctggagtgcagttgccacctctgcctcctaggttcaagcgattctcatgcctcagcctcctgagtagctgggattatagacgtttgccaccacacctggctaatttttgtattttcagtagagacagggtttcgccatgttggcyagactggtctccaactcctggcctctagtgatctgcccgccttggcttcccaaagtgctgggattacaggcatgagccaccacgcccagcccagttctgttcttgaccccttccttagccataatctaacccatatctaaccctgaccctacagctaactggggccccaaactcaatgctaaccaaatcaccccttcccagcacagcatgggtaatgctcctcaccttcctctgcccctcagtcttcctccttaccgtaggctgtacttcccatgccctagcctccaattctccatcccc

SEQ ID NO: 206447 - DNA, 601 bp, Human
ctttgccttccagcctacttccagtgccacccatgttctcctcctccctggtcctatccagatgcagactcttatgagaacatggataatcccgatgggccagacccagcctggggaggagggggccgcatgggcacctggagcaccaggtgatcctcaggtggccaggtgagctgggactgcccctagggaaagcggggagggagggagataggcacggatggcagtggctgctggctttcagggagggagagggaacagggttcctagggcctggtgggcagggggaggactgctggayccctccccatcaccgtttcttctgcatagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcctatgaagtagtgccattgtgtgggaaggaagggaaggaaaggaaaggaaggaaagggaagggaagg

SEQ ID NO: 206448 - DNA, 601 bp, Human
gcataacctgtctgccatctcgacagatcccaaggtctgtctctttctgtcactgcctttgcctagatagaagccagaaaggaaaaactggcctaggatagtctctgtttccagaaacgtagtggatagtgccattggtgagccaaagggcagtagagtgggaatgaaatagaaattagattttagtgcgttttgtgttcagagtgtaccgaatttatcagtttctggagcacatcatgtcttttcatgctctgtgtctttttttcgttacattttatggcttctttttttttttttttttacatcttttgccttcctagcgcttgacatctttctgatcatccttcaaacctagttcggaaacacttcttggaatctctgtaagaattaattgcacccccgatattctcatgatacctttttcttccgtttgttaaaacttgctttgtctttttgtaagcatcacatcctctgtgtggtactcggtaagtttcttaacttctgaaagcctcagttttctactttttctaaattgggataataatacttacctctcttgaggattacacgagttaatacgtttggaatatttagatcagag

SEQ ID NO: 206449 - DNA, 601 bp, Human
taattgtgttctaaaagtgcataagttagctgttttagaaattacttgctcaaagaaataaatgataaataatggctaattttctaagtaagcctacagtagttgagtttcctcataatacagttgaaatattatatattttatagttaatatgttatatattatatattaaacatacttaatgttatatattatatattaaacatatttaatatgttatatattatatattaaacatatttaatatgttatatattatatattaaacatatttaatatgttatatattatatattaaacttttaatatgttatatattatatattaaacatatttaatatgttatatattatatattaaacatatttaatatgttatatattgtatatattaaacatatttaatatgttatatatattaaaacatataagccaactctgaacctgtggtgtcacctcttttttatttttattttttgggacggagtcttgctctgtcgcccaggctggagtgcagtggcgtgatctcagctcactgcaagctttgcctcccgggttcacgccattcttctgccatagcctcctgagtagctgggactaca

SEQ ID NO: 206450 - DNA, 601 bp, Human
ggtgtcacctcttttttatttttattttttgggacggagtcttgctctgtcgcccaggctggagtgcagtggcgtgatctcagctcactgcaagctttgcctcccgggttcacgccattcttctgccatagcctcctgagtagctgggactacaggctcctgccaccattcccggctaattttttgtatttttagtagagacggagtttcgccgtgttagccaggatggtcttgatctcctgacctcgtgatccatccacctcggcctcccagagtgctgggattacaggcgtgagccacygcgcccggctggtgtcacctcttaaatcatagggtagtggacacgtgaagctatttagggtgttcttggcatgagttatttagcaccatccccaagtcatgtggcattaggaaaatactttggattgtataagaatgacctaatttcctaggcacctggttaggggaaagtatcagaatgtagaaattggccaggcgtggtggctcacatctgtaagcctagcacttcgggaggccaaggctgggatcacctgaggtcaggagtttgagaccagcctggccaacatggtgaaaaccccgt

SEQ ID NO: 206451 - DNA, 601 bp, Human
tcactcaggattttcttcactttccccttttttccttttggttaagtccatgattgatatcagttctaatagcccagaaaccaagatgatgtcactaaagggcaaatctggactgtgtcacagcttattagcttctgggattcaggccctagaataacctccctatcctgtacagtgccccttgtggcccccaggttggcctgctgattcttcttgacctgatgaccagcattatgttgtaattaatggctttgaagtgccagatcctgggatggagggttttttaatgtctgaggatgcrtgttggcagagctggccaattgctagcctagaatagttagcttatttgggggtattagctgccggggacagtaaacagaaaccaagaggaggtactaacttttccaccattcttggccacctctctattctgtatactcttcagagttaagtactgtgagtaaggttgaaaaaaaatcacttttccatttttatccatggttgtaggggaccaaatttttagagccctttaaccgtgtggattgggccagggacacagcaaatgcatatgtgaaaaatctccaagtgtggctagcattga

SEQ ID NO: 206452 - DNA, 601 bp, Human
ttttggttaagtccatgattgatatcagttctaatagcccagaaaccaagatgatgtcactaaagggcaaatctggactgtgtcacagcttattagcttctgggattcaggccctagaataacctccctatcctgtacagtgccccttgtggcccccaggttggcctgctgattcttcttgacctgatgaccagcattatgttgtaattaatggctttgaagtgccagatcctgggatggagggttttttaatgtctgaggatgcgtgttggcagagctggccaattgctagcctagaatrgttagcttatttgggggtattagctgccggggacagtaaacagaaaccaagaggaggtactaacttttccaccattcttggccacctctctattctgtatactcttcagagttaagtactgtgagtaaggttgaaaaaaaatcacttttccatttttatccatggttgtaggggaccaaatttttagagccctttaaccgtgtggattgggccagggacacagcaaatgcatatgtgaaaaatctccaagtgtggctagcattgattgctttaaataaaatttgcagattttaatttacc

SEQ ID NO: 206453 - DNA, 601 bp, Human
gtgcagtggtgcgatctaggctcactgcaagctccacctcccgggttcacgccattttcctgcctcagcctcctgagtagctgggactacaggtgcccgccaccacacccggctaattttttgtatttttagtagagacggtttcaccatgttggccaggatggtcttgatctcttgacctcgtgatctgcctgcctcggccttccaaagtgctgggattacagtgtgagccaccacacctggctactttatttttttttaattaaataaatattttttttcatttttgttattccattccttttctaagttagctgataagctttgtgcttttgaatttgagaatttccatttggttctttttaagcatttctgtctctttactgatattctctgtttgatgcaacgttgttatcataccttcctttacttcttggtttccttttgttcttggaacataatggctactttcaagtttgttaatctgacatctggttgcactctcaggcagtttccgttgcttgcattttttctagcatatgggtcattctttcctgtttctttgcatgtcttataattttttgttggaaactagacattt

SEQ ID NO: 206454 - DNA, 601 bp, Human
ccattcctctgagctggggggaaggagggagtgggtcttggtttaaatatatatatttttctcttttttaaatttaatttaattttattattattatactttaagttttagggtacatgtgcacaatgtgcaggttagttacatatgtatacatgtgccatgctggtgtgctgcacccattaactcatcatttagcattaggtatatctcctaaagctatccctcccctctccccccaccccacaacagtccccagagcgtgatgttccccttcctgtgtccatgtgttctcattgttcarttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaat

SEQ ID NO: 206455 - DNA, 601 bp, Human
atatgaaaatctttagactatgaatgtgtatttctaacttctctttgggaagagatgcaccaatatactttttcattaccagtgcagcagactgtccattttttgcagccttgccgttaaaacaaaacaaaaaactgaatggtgttaattagatatgcacaaatggtacttgttaatttaatttgtgattctttaattgttaaataaaacttttgtcattttagttacctgcattttttgctttgtgaattgtttccttttgctctttttacaccctttgagtgcattaaaaaaaaaaaamaactttgcttagactgtttatatttaaccatcatactagttgcaaatattttttcctactatttgccttttaatttcatttataaattttcatagtgttacagttagaagttttatatctcaaagctattcaatgtatagatgagtggattaaaaggaaaaaaaagctgttgatttttttcatttgccatttatttaatttatatttagtaagtacatttccatccagagataagatatgtatttacttgtagttccttttggtttttctttttgccttattatgtgtatgtgtgtgtgc

SEQ ID NO: 206456 - DNA, 601 bp, Human
catgagccaccgtgcccagctaacccttttttttgtctgttttgagtagtacagctttgtagaattggacagatttaatggtgcagaagaaaggacttaggagaccagaagaactcttttcccacatgagcacattggctgcatcaacacaagattcttgggcataaacgagttttgtcatatcctgacattcctagtggggatatttattaaactgaaattttgtctttaatttttttcttagtacaccttaggatatttattttggtaaaattactaacacaacacctttagattttcwtagggatcttgtggctcgctggactctttctgtgtgatattttaattggttttcagtcttcctcctccaattttgtataaatactgctattttacattcttggtacgttaatatgttgatttgaaagaatttcagtatagagatacagcctttgtagcttgattctatatcatatgtgaattttcccctcacattctgtagggaaggctttctaaagctatattatggaaactttcaaagccacaaaaaagatgagtactactgtgaactcgtgatattaatcacacagcttcagcaatt

SEQ ID NO: 206457 - DNA, 601 bp, Human
agtgttagttcttttgggtcagtgttagttgtttttgcttaggttagtcatattcctcagagaagtaatttccagtctcctatctacagggtataaagttggccagtctctgggaacctagttggggaaaaaggctggatgtctccaatctaaaataaaaacttctgcttcatttctctattttcatagtgataattttgctcttaactcttcctggtattctctggtttagaaatcttttttgtactctcttcagagagtaaagcccctctgttttttgtaaatcctgtgagagacagasagagagagagagagagagagagagtgtgtgtgtgtgtgtgtgtgtgtgtgtgtgtgactaaaaatcctatagactttgttttttattatcactctttttcttctcattttatattgtttcgtgaaagtttacaaaattatggcacactagttattagccagctcaaggctttgaggaggtctgaacatagggtttctcaagtaaataagtaaaatatctagcatatcagaagctttaaaaacaataatgtgatcttgcatttatttccttggattctgaacacaagtaaggaatgtgttt

SEQ ID NO: 206458 - DNA, 601 bp, Human
tgaatattcacacttgaaattaaaaaaaatagtttttttttttaattttgggaaaaaattacattataggacaatataagggacatttaatggaactcctttcatggtttttaaacagttttattgagataccattcttacagaattcacccatttttactgtatttaccgagttgtataaccatcaccacagtcaattttagaataatttcttttttttttttttttttttgagacggagtctcgctctgtcgcccaggctggagtgcagtggcgggatctcggctcactgcaagctccrcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcccaattttagaataatttcatcatccagaaagaaaacccatacccattagcagttattccccattcccctcaaacctgccaagttttta

SEQ ID NO: 206459 - DNA, 601 bp, Human
aagggtttatttctggactttcaattctgtctcattgatctattatctatcctgtgccagtaccacactgtcttaattcctatagccttgtagtatccttttgtgtttttaataggctttttaactgattgttaaagaatattgaagtaatgagtgaatgttaactgggagcgtagtagttattttgaaaaagcacaaaacaggtttagaacctgagccatatgcagtaagtttggggcttgtaactttggatttctcttctaaaagatgtgggggaagttatatatttgttggaattggstttagctgtaacagaaaacctctaacagtggcctaaatagaatagaggtttatttctgtttcatgttctaagtgttgagagataaatcaaactggggcttgtgtggcactccctggtgtcagggacctgggcacctgcttttttgtcctcccccatgtcaggtttctcttcttagtttctccttgtggcaggtacagtcgctgcagggccagccgtcatgtttgcatatagcctgcaagaaggaggaaaaagggcacaccctttcccttcttaagaacacatctcttgcacacatcattc

SEQ ID NO: 206460 - DNA, 601 bp, Human
gtgatttagtgcattttactatgcttatgacttctgtgagtcaggaattcagacagggcacagaaggagtggttagtctgtgctccatgatgtctagggccttagtaaggaggactcagcggttctgtgtgatttgatggataggggatagagtcatttggaggtgttgtctttccatgtctggtggttgatgctggctgttggtggggtgggtcctcagctgggaatgtggagtgaatctgcatgtggtctttccatgaggcttgggctttctcatagtgtagtggtctcagaacagttsaacttctcacgtggtatctcagggctccactgtgagtgcggtgggaagctgcgttattttttctaaactaacctgggaggtcaagcattgtcacttttgttgtgttctgttggtttcaggtgaatcacaagcccacctagatttatggggagggaacatagaccctacctcttgatggaaggagtatcacagttggattttaagaacatgaaacatgagagagaaggttgtgaccatctttggaaaataaactttgccacaggccctaagttggacataaagagatttatgggtacaaag

SEQ ID NO: 206461 - DNA, 601 bp, Human
tttctaaactaacctgggaggtcaagcattgtcacttttgttgtgttctgttggtttcaggtgaatcacaagcccacctagatttatggggagggaacatagaccctacctcttgatggaaggagtatcacagttggattttaagaacatgaaacatgagagagaaggttgtgaccatctttggaaaataaactttgccacaggccctaagttggacataaagagatttatgggtacaaagatagcactgaggacagggttacagtgaagggactaaagagaacatggtcagttctgcctraagagatcagcaagacttctgaaagggacctgacccccacaagttgttttcttgtgcagtggaaaggttgcttgggagtatcttaagttcccagtagaagaaacagacctcagagatactaatgaagactggatagagaattcagtggtgaagccagactaaaacccaggcattcagacatttggcctaagctgggaaatttgaattcttgtaatagtaatttcatatgtgaggccacaaaagcacacctctacacataaaactttatttgatgtataaaacttctttttaaattttatt

SEQ ID NO: 206462 - DNA, 601 bp, Human
tggacaccccattgaaaggtggacttaataccccattgcatgagagtgacttctcaggtgtaactccacagcgacaagttgtacagactccaaacacagttctctctactccattcaggtattgtaaatgaacacgtttttattttagaaaaacttgaattcaaggacttagcatatttgctttagtaatgtttacggagaatgactacttattgtgttggattttcctctttgatttcttcttcatagtaataaataatagtgtccaggaaatggttaaatactgtggagtgcctccccscctttctttaagatggagtctcgctctgttacccaggctggagtgcagtagcgcgatctcagcttacggaacccctctgcctcccgggttcaagcgattctcgtgcctcagccttctgagtagctgggattacagacatccgccaccatgcctgtctaattggagtgttcttttgcaaagcttcggatcctatcacgttatttttgaatactttgtatttgattttagagtagattgattcatttttaatgattactttgtgaattttattatgtaatccttttatgtatgtattactat

SEQ ID NO: 206463 - DNA, 601 bp, Human
acaagttgtacagactccaaacacagttctctctactccattcaggtattgtaaatgaacacgtttttattttagaaaaacttgaattcaaggacttagcatatttgctttagtaatgtttacggagaatgactacttattgtgttggattttcctctttgatttcttcttcatagtaataaataatagtgtccaggaaatggttaaatactgtggagtgcctccccgcctttctttaagatggagtctcgctctgttacccaggctggagtgcagtagcgcgatctcagcttacggaacmcctctgcctcccgggttcaagcgattctcgtgcctcagccttctgagtagctgggattacagacatccgccaccatgcctgtctaattggagtgttcttttgcaaagcttcggatcctatcacgttatttttgaatactttgtatttgattttagagtagattgattcatttttaatgattactttgtgaattttattatgtaatccttttatgtatgtattactattgctttccctccagcattttattatgaaaatttcaggcatttagaaaggttgaaagaatgtgtggaagttatc

SEQ ID NO: 206464 - DNA, 601 bp, Human
atgattttgaaattgttctaccagaaaatgccgagaaggagctggaagaacgtgaaatagatgatacttacattgaagatgctgctgatgtggatgctcgaaagcaggtgggtaactgtactgaaagaagcgtgagtttggctgaatgtgtcagtaggctggaagaatgaagaatagccattaaatgtcccaagatctctacctagtcctttttaatattgaaaaaacttctaaagtaaataacttatgtcattaataatgtatcctcacataattaacatactcacaatattttgatgarcattcttaaaaatatatatatggaaatttaaatacattctgtcaaattcattatgcttctctaaaatacacataggtagtcttttagacattgcttcaatctagcaaagaaaagatgttattggttagtcttaaaaacaaatacatcttggttcctgggtggtgcgatgtacgagcctgtagtctcagctgctcgagaggctgaggtgggaggattctttgggcccaggagtttgaatccagtccggggaacatagtaagacctctatctaaactggagttggaaatttagatagagtgt

SEQ ID NO: 206465 - DNA, 601 bp, Human
atttaaccattaagatcacatatatataggtagctgatggttaatgcctgtgaacctctttttttctcagtgagaaatgactggttctgaagtaattctcatcttgggtaaaatcttagttcagtgctgctaattatttgtattaccaacttccagcagggtgtgctgttgctctgtgttgtggttcagtgttaaagccagggaaaatagaacatcagtggttaaattgtaagttacatttttttgttgtgtaggcttcatttcttataaatggtagttagcagtgtaattgtgatctaakatcagcatcatcactgattgaaaagctatttggaaagcttctttgtattatttatatataaatacttaggtttcttacttagtatgaaaatcttctcatttgaggtgggtaaactctttttgccgcaaatggcaagaacattttgtgcttttttaaatggtagaaaatttttttctccctaaatctcatttactttgttgaggtactaactttcatgacagcaaataaatgtgtcacacagtgagtggtgccataaagtacagtaatttttatttctgtgttgaattggtcttatgaatt

SEQ ID NO: 206466 - DNA, 601 bp, Human
tttaaccattaagatcacatatatataggtagctgatggttaatgcctgtgaacctctttttttctcagtgagaaatgactggttctgaagtaattctcatcttgggtaaaatcttagttcagtgctgctaattatttgtattaccaacttccagcagggtgtgctgttgctctgtgttgtggttcagtgttaaagccagggaaaatagaacatcagtggttaaattgtaagttacatttttttgttgtgtaggcttcatttcttataaatggtagttagcagtgtaattgtgatctaatrtcagcatcatcactgattgaaaagctatttggaaagcttctttgtattatttatatataaatacttaggtttcttacttagtatgaaaatcttctcatttgaggtgggtaaactctttttgccgcaaatggcaagaacattttgtgcttttttaaatggtagaaaatttttttctccctaaatctcatttactttgttgaggtactaactttcatgacagcaaataaatgtgtcacacagtgagtggtgccataaagtacagtaatttttatttctgtgttgaattggtcttatgaattt

SEQ ID NO: 206467 - DNA, 601 bp, Human
cctctgcctccagggttcaagcaattctcttgcctcagcctcccaagtagctgagattacaggtgcctgccaccacgctcggctaatttttgtattttagtagagacgggtttcaccatgggtcaggctggtcttgaactcctgacctcaagtgatccacccaccttggcctcccaaagtgctgggattacaggtgtgagccaccgtgcccagccgagtaattgtttttatttgatggaagcatgagtttgagataatataagattaaatgagatactgtatgattagcaaatagcaggtkttagtaaatgggaattctcctcccatgtgtcttcaagtctatatcacccttagagttacctaaattggattatacttggtttgatactatgaggtattaggaactaacctcactttaaacaatcgggtggctaagtttttatattctgtaaattttgaggaatgtctgaaattttagacatgggctgattttaggagagagattgttgtactgagtgaagcttaaaactcagattttggttagcgtaaatagattttacatcgtggattttaatctaacatttcatgtatacattttggt

SEQ ID NO: 206468 - DNA, 601 bp, Human
aaagtgctgggattacaggtgtgagccaccgtgcccagccgagtaattgtttttatttgatggaagcatgagtttgagataatataagattaaatgagatactgtatgattagcaaatagcaggtgttagtaaatgggaattctcctcccatgtgtcttcaagtctatatcacccttagagttacctaaattggattatacttggtttgatactatgaggtattaggaactaacctcactttaaacaatcgggtggctaagtttttatattctgtaaattttgaggaatgtctgaaatttkagacatgggctgattttaggagagagattgttgtactgagtgaagcttaaaactcagattttggttagcgtaaatagattttacatcgtggattttaatctaacatttcatgtatacattttggtgtgttgaaatagttgacatatttgtaaattttaatgtctcattatatttcactacattgatgtttcatgatttgtggtgtatggtcttgagaaagtagcctttagagtagatacaatattgaatttgacttttaaaaaatcttataagaattttcaaatgtaccccagagtatac

SEQ ID NO: 206469 - DNA, 601 bp, Human
gcatattgagcagtcataggttgagcattttacaaagcatgcagataccctcctttgtgttttaataatcaaatgacaggcgtaagataactaagttcaacttgaatattaaaagctgtagtccatttcttctttatatgtttaatgactatatagttatttggctaaattaatttttttctgtgcttaagttaatttttgtacaatttatgtccatatttgcttggaaccttagcgcaatatttgagccagaagacttgcaaagcttgagctaaatgaaataaaattgttggcattaaakgaaagctaacaactttgaagttttaaaatctctgatggtttgagtataagaaatgactccattggatgaggtgaggtaattccaagatacagggtactgataatactaaacgtaccttgatgactaattaagcagtttctgagtataggtattatgctgtaaaaccaaactggaaatggactatccatggagcatagtgtatagctgagttatcaatgaaaatgttaattcgtatgattaatttttaaaaagcattatatgtattaatttgaaattctttgctgttaaggttttggaatg

SEQ ID NO: 206470 - DNA, 601 bp, Human
caagtgatccatccacctcagcctcccaaagtgttgggattacaggtgtgagccaccatgcccagcctaaaaatcccttcttttagctattttgaaataaacatgattctgtgattaccatgctatgtaatagatcaccagaacctattcttccgtctaactgaaactttgtacctttgaccaacatctcccctttccctatctaccctttaccccagtatcctctggtagccaccattgtactctctacttctatgagattaacatttctagattccatatacaagttaacatcatatgrtatttggctttctgtgcctggcttatcatagttagcagaatgtcctctgtgtccatctgttgttgcaaataacaggatttcctgttttttaaagactgaatagtattccgttttatgtgtataccatattttaaaaatccgtgtcttggctgttgtggataatgctgtaaagaacgtggaagtgcagacatctctttgacatactgatttcaattcctttggatatgtatagccagaagtggaatggctggattgaatgataattctgttttcagttttttgaggaacctccatactgtt

SEQ ID NO: 206471 - DNA, 601 bp, Human
tttttttcatgtacctgttgaccacttgtatgtcgtcttttgagaaatgtctattcaggtcctttccccattttaaaaatagggttacttgttttttattgagtagtttgaatttttttgtttgtttgtatattttggatattaaccccttatccaggccgggagtggtggctcacacctgtaatcccagcactttgtaaggtcttgttctttttttttttttttttttttttgagacagagcctccttctgtcgccaggctggagtgcagtggtgcgatctgtgctcactgcaacctctrcctcctgggttcaagctattctgctgcctcagcctcccgagtagctgggactacaggcgcccgctaccatgcccggctaatttttatatttttagtagagacgggatttcactgtgttggccagaatggtattgatctcttgatctcatgatagacccacctcagcctcccaaagtgctgggattacaggcatgagccgccatgcctggcctactctatgccttttgattggggaatgtaatccatttacagagtaattattgataggtgaggacttaaccagtgccaattgttttctgt

SEQ ID NO: 206472 - DNA, 601 bp, Human; identical to SEQ ID NO: 31582

SEQ ID NO: 206473 - DNA, 601 bp, Human; identical to SEQ ID NO: 31583

SEQ ID NO: 206474 - DNA, 601 bp, Human
tatgtctgagactcagtttcctgtcaatcaggtggtgggcagagctttagagacccagaatcagggactctaaaatgccatcaggtggggaggtggggagaagttggctgccccaccgctgttttccttccccttcctccccacactctcagctcatttctgcccctcttcccccaaatctgtcaggaagcccctggatgcacaggtgggtcaaaggatgtccacaggaccggccagcggcttgaggtggccgagggatagggagtgggacatggggctgggggtcccttgctcctcaccrcccctcctctggtcagtttcagaaagcagcagaggccatgaccccttggaagagcccccaggccaaggagccccacagaacccctaacctggcctgcacccactcctgcaccctttctggggatcagggaggtaggagggaggcagggcagggccctgcagccttggcctgttcaaagggtttgaggagctgcccaaaggccctggggaaggtgagctggaggaacttaaagctaaaaataaaacaacacagaagtggccagtctgccagagccctctctgcaatgatccctcaccaccc

SEQ ID NO: 206475 - DNA, 601 bp, Human
ttgctgagaagattaaatttatgttcaagtgctatttctttgcggcactgaggaacaagcattttgtttctaacaccacaaacatccatttgtggaactggctggtcagggctgcctctgacctgctgggtgacccacatcaagtccccccaccattctgggactctgtttccctatggctagtgggtggggaagagcgggggtggataggacatattctaagttctactaggggtctgacagtctgagatttcacctaaggatgaaggcaggaggaagacagagcagggcatagatgggrctgctgaaggtaaaggcagggtcccaggggttgtaccccggatgggagggccgttatggggaccagagaaaaggctgagtgcctgcggggagaagatcaggcaagaggaagatccccatcctctccactgtggcagcacactgcagtgcttaggcccagggcttgagccccagtggctcatttcagggcagtgttacttgggtaaatttcttcacctgactgagttatacgagtacctcagtctccccatctgtcaaatgggggcagaaagagtatctcctttgtagggcttttgcaagc

SEQ ID NO: 206476 - DNA, 601 bp, Human
gatacttttcttcccgctgccaccccccctttttttttctgagatagagtctcactctgtcacccaggccagagtacagtgtctcgatctcggctcactataacctccccgtcccaggttcaagcgattctcatgcctcagcctcctgagtaactacaagtggaccaccacactcagctaatttttgtattttttgtagagacggggtttcgccgtattgcgcaggctggtctcaaactcctgggctcaagcaatccacccatctcagcctcccaaggaagatacgtttcaacaagggtcyttcttgctgcaatgcctgccccgtcttgttcagtacccccgggccactctttacccttttcaggcccaattacagcctcacaggtttcccagcatccagcccagccactgcccccagccaccaggaggtctcagcatgccttggccccgggctcccccctggttctacgatgcctgcagggtcaagttcctgcactgcagcctacagtagaggtgaaaagcacagcgatttgacagatgccaaaggttcaggtcctgattcttccacctgccagctgcctttccatcctcagtgttctca

SEQ ID NO: 206477 - DNA, 601 bp, Human
ttatttttcagacaaggttgccctctgtctcctgggctggagtgcagtggtgtgataacagctcactgcagccttgagctgctgggttcaagcgatcctcctgcctcagcctcccgagtagttgggactacagttgggcgccaccacgcctggctaattttttaaattttcagtagagactgggtctcactatgttgctcaggctggtctcaaactcctgagctcaagcagtcctcccgcctcagcctcccaaagtgctaggattacaggtgtgagccaccatgagtgagccagcatgcckggccggcagctttctcttaattacaattatttgactgacttcagtcactgtagaattgactgttctaaggggtggggtgaagtggcgggatggggtggcctccaggtgacggtcctctgggatggagaggtcactgggatctccctcaccccaacaaaatcaagggctggtgccatctcctgtctccagtccctctgacccaccagcccccatgttctccccaccctctcctttcctcatcggtgagcgcaggttccttggctgttacctagcttaagcccctcctactcagatggggag

SEQ ID NO: 206478 - DNA, 601 bp, Human
gcccaatgcttaccagctatgtggctctggtgaatgatttcacctcttggggcttcaatacctggtctataaaatgacaacagagcccacatgatccacagaggtggctgggaggactccatgagactgggcacatggcaattctttcttaaatttctatttgtttatttttcagacaaggttgccctctgtctcctgggctggagtgcagtggtgtgataacagctcactgcagccttgagctgctgggttcaagcgatcctcctgcctcagcctcccgagtagttgggactacagttgkgcgccaccacgcctggctaattttttaaattttcagtagagactgggtctcactatgttgctcaggctggtctcaaactcctgagctcaagcagtcctcccgcctcagcctcccaaagtgctaggattacaggtgtgagccaccatgagtgagccagcatgcctggccggcagctttctcttaattacaattatttgactgacttcagtcactgtagaattgactgttctaaggggtggggtgaagtggcgggatggggtggcctccaggtgacggtcctctgggatggagaggtcactg

SEQ ID NO: 206479 - DNA, 601 bp, Human
cttgtcgcgctcacttcctgttttcttggagatcaaagatgggcgcggagagactggcttcatgtccagccaaggccggctcagaggagggggcagggaggcttctgctgaaccctgggctgtctggagcctcaccggcctccttcctcaccttcccacagcacgttgggctctgggccccagaagtcagcaaaggaagtgagatggtcaccccttgccatggcaacgccattcccagctctgtcttgggaaggagaagatctggatgaggacttctggctgccacgggggcccaggcctyatatgtcgtctctctgaccctatcctacatgtcccagggactctggagtgcctggacatagtggcattttggttaaaagcaagctccctggagccaggctgacctggtttgcctctcaggcccaatgcttaccagctatgtggctctggtgaatgatttcacctcttggggcttcaatacctggtctataaaatgacaacagagcccacatgatccacagaggtggctgggaggactccatgagactgggcacatggcaattctttcttaaatttctatttgtttatttttcagacaagg

SEQ ID NO: 206480 - DNA, 601 bp, Human
gctgccagagcagaccgcagagcccggaaacacaggtcctgagggaaaggaatggaatttcaccctgacccagcagggtcggaaaaggaaatgaggctcctacacctcgtcctgaggaatgtgccgggggaagggggctccggaggagggaaggaggacagaaggggagactgtttggaagtttgtgtctccatcttgtcgcgctcacttcctgttttcttggagatcaaagatgggcgcggagagactggcttcatgtccagccaaggccggctcagaggagggggcagggaggcttctkctgaaccctgggctgtctggagcctcaccggcctccttcctcaccttcccacagcacgttgggctctgggccccagaagtcagcaaaggaagtgagatggtcaccccttgccatggcaacgccattcccagctctgtcttgggaaggagaagatctggatgaggacttctggctgccacgggggcccaggccttatatgtcgtctctctgaccctatcctacatgtcccagggactctggagtgcctggacatagtggcattttggttaaaagcaagctccctggagccaggctgacctg

SEQ ID NO: 206481 - DNA, 601 bp, Human
cttcgagacctggctagtggtatatgtcacctcgcccctctcggggcccacaggctgaaggtcacaatggactgtttctgcaagacctgttggagaaacatccggaaagaggccaggtgagaataaggtgatgacaatgactcctactttccaaacgtctcctagggacttgacatgagctaacggctttcctgcatcatcacagccaccttatgaggtggatatcattatattcgttccatggattaaaaaaaaccaaggctaggagaggaaacgtctcctgcccaaggtcacagcgctrctacgtatagggtcgatgaatagaaggacacccagctaaatttaaatttcagataaacaatgagtgcatttttttaagtattagtatattgcaaatattgcatggaacgtacttatactaaattttcattgtttatctgaaattcggatttcactgggccccatgtatatatgtgtgtgtgtatatatacatacacacacatatacatagatctacatatatacatacatatatacatatatagatatacatatatacacccacacatccacatacatatatatatatatatatattttt

SEQ ID NO: 206482 - DNA, 601 bp, Human
aataacagaccctggcagatgagccttgggaggcttaatacatgtgagatgcttaattcctggcatagagtcggccctagcacagtctctagcacatagcgcttaacaaaggtgttgttattattcaggacagacgtatcagacaaactgatggtgggctgggagtgggggtctcctggggagaatcgtctccaggccggcagcagcctttggatctctgagggtcacagatattcagcaggggacattccagggagaaagatctgggctcaactgaaaagcacttctctttttcttttcttttttttttttttttgagacagggtctcactctgtcacccaggctggagtgcagtggtgcaatgttggctcactgcaacctccacctcctgggttcaagcgattctcctgcctcagcctcccaagtacagctgggattacaggcatgcgccactatgcctagctaatttttgtatttttattttatttttatttttttattttttatttttttgagacagagtctcactctgtcaccaggccagagtgcagtggcacaatctcaagctcactgcaacctccaactcactggttcaagcaa

SEQ ID NO: 206483 - DNA, 601 bp, Human
tacaggtgtgagccactgcgcctgacctgccccattgatcttgtagcaataaccattgaggttcaaattattcaactgatacgaagacattctgtaaacggtaacaaccctggcaaaatggggatgttcacagaggagaaatggaacccagagagaaataataataacaataaccgtagccaccatacgctgagccgtcactccaggcaggtcctgcgcttggtgttttgcttgcaccgtcctgctggattcttacaacacacctgtgaggtaggtgctgctaatgggtccaggtttcccrtgggaaaatcaaagctcggaggtggcccaaggcgatgtggctctcagaggcggagccacagttcagctggagggctgcctggctccagaacctgtgttctcaacccctgcatcaaggtcatacagcggcgcacacatttgtgcacgcatgcgtgcattcactcacacgttcaagagttacttggggccagacgcagtggctcatgcctgtaatcccagcactttgggaggccgaggtgggcggattatttgaggtcaggagttcaaaactagcctctccaacatggtgaaaccctgtctc

SEQ ID NO: 206484 - DNA, 601 bp, Human
aatcttttttttgttgttgttttgtttttgagacagggtcttgctctgtcgctcaggctggagtgcagtggtgcgaactcggctcactgcaatctccacctcccgggttcaaacgattctcttgcctcagcctctctaatagctgggattacaggcacctgccaccacgcctggctaatttttgtatttttagtagagatgcggtttcgccatgttggccaggctagtctcgaactcctgacctcaagtgatctgcctgcctcagcctcgcaaagtgctgggattacaggtgtgagccacygcgcctgacctgccccattgatcttgtagcaataaccattgaggttcaaattattcaactgatacgaagacattctgtaaacggtaacaaccctggcaaaatggggatgttcacagaggagaaatggaacccagagagaaataataataacaataaccgtagccaccatacgctgagccgtcactccaggcaggtcctgcgcttggtgttttgcttgcaccgtcctgctggattcttacaacacacctgtgaggtaggtgctgctaatgggtccaggtttcccgtgggaaaatcaaagct

SEQ ID NO: 206485 - DNA, 601 bp, Human
tccatccgccatcccatggtgacacccacaggccaagcatgctgcagaagccagagtgcagtctggtggccaagccctgagtggggatgaaggagccccatggccatccagtcctactgctgctccgccactgtccctgttcctctatgcctcagtttcctcatctgtgaaatgggggtaggacagggttgggaaccagtaccaggttgggctatggataaaggaagtgaaaaaaaagggaagtgcaggtcacagcctggtcatgctgtctgtgaggggtgacgaggaggctggaacttcrgaatgtttcttgggacactcagctctcatcccagagctcacgaaccaaagctaccactcagttgtcaccaagtccttccctgcaggcttgagggcaggtaggaggtgggggcaagtgagtagttgggaaactcaggggggctggaaagctgggtgctcaggttctctgagctgcagggccaagctgaaaaacagctggttaccagaaaaacccagtcagggtttctacagcaaacatttccctccccacggccctgactcaccgccacggccactcacacgcacaccgacttcccccttc

SEQ ID NO: 206486 - DNA, 601 bp, Human
ccctacgcctcagcctcccaaagtgctgggattataagcgtgtgccaccacgcccagcctaatttttgtatttttagtggagatggggtttcacctttttggccacaatggtcttaatctcttgacctgtgatctgcctgcctcagcctcccaaagtgctgggattataggtgtgagccactgcgcccagttaggttggttatttttaaataattattttatgctaatttatgggataagatatgtttcaaatttatgtttgtataagttcatgttttgattaatgttttctagtgggttyataacttttggttttcaaaatatattgtttcatcagttttgaataaaatatatatatatataatttttttcttttaagacagggtctccctctgttgcccaggctggagtacagtggcgtgattgctcactgcaacttccgcccctcaggctcaagtgatcctcccgccttagcctcccaagtagctgggactacaggcatacaccagtatgcctggctaatttttatattttttgtagagatggggtttcactatgttgcccaggctggtgttgaactcctagactcaaacaatccacc

SEQ ID NO: 206487 - DNA, 601 bp, Human
gcggaatgggaaagggctgggacactggctttacagctgggttgggaaagggatctgatccttgagtcagcccctgtaaaatggggatacagcagggcacgacgtctgttggtcgcctggcactgggtcggccaccgaggccgcgccttggcctctttgtcccctctggccaccggccccagggagcccgctcgggaagcagcgcggccccaggaggaaggcggcgcggccgaggccagagccggcggctactgcgaccttccggctggcgggcgcgtttcatgttcctgcctcaccctgrgctgcacggactcagatcgggaagggggaggatccatggtaaaggccacgccccctctgggacctcgattccccttctgggcggccgagggatgggctgcaaggagtcaaatcctcttggccctggtggttggatttggccccctccctcctaggactttggcatgctggcttggtcatgtctgactgtctctgtgctgtccctgtcaccagtccggaagcttctcccctgtcccccacgcccaacttcgctcaagcctgcctccctcccgcagtgggcatgtttctttctatgcctctc

SEQ ID NO: 206488 - DNA, 601 bp, Human
ccacctgtggggtagcagaggcaggccaggcggctggtcactgtgtgatcactgtgtgcccgcaccaggctttttttttttttttttttttttttgagacggagttttgctctgttacccgggctggagtgcagtggcacgatcttggctcactgcaacctccatctcccaggttcaagcgattctcaggctcttctatgattagctactcccattgttcccatgtgcagatgagaaaaatgaggctcagagaggctgatgtaccttgcccaagctcacacagaggtgcttcaccaacagwgtggccactgatccaagggaggggaagggaagggaggggcaggggaagggtgctcaccgcagctggaggcatgaagtgagacaatgctggccagcggtagctccacgaaggatgccacaatgctggcattgagcatccgggcctcccccaggaggccttgaggtgtgtctgggagcttgaagccacgaatgtttttctctggaaagatcttgaaggagtattctccagtggtctaatggtggggagagaggcagaacagggggccatggacacagtctgtgccacagcaggccagccagg

SEQ ID NO: 206489 - DNA, 601 bp, Human
gaggcaggtggatcatgaggtcaggagatcgagaccatcctggctaacatgatgaaaccccgtctctactaaaaatacaaaaaaattagccgggcgtggtggcgggctcccgtagtcccagctactcgggaggctgaggcaggaaaatggcgtgagcccgggaggcggagtttgcagtgagccgagatcgcaccattgcactccagcctgggcaacagagcgagactccgtctcaaaaaaaaaaaatatatatatatatattccttcaagttccacatataatcatcactcacagccccargggcatgcaaaccctgcaagcataatccagtctcaggcctggcgtgggcgaagtgttcctataaagagccagatagtaaatactgtcatgcaccatgggacaatgttgtggtcggtgatggactgtgtatatgatggtggtccctggtcccataaaattataacgaagctgaaaaatttctattgcctagtgtttgtggtgatgctggtgtaagcaaacttattgcactgccggtcatataaaagtctagcacaggctgggcgtggtggctcacgcctgtaatcccagcactttggtagg

SEQ ID NO: 206490 - DNA, 601 bp, Human
caaagctctgctgccccggctcgatggtgttggaggcctggaggaagtgtgggctgaggtagaggcccagctggaaagagaggctgtccatgttgaggcagtgcacctttttctgggggaggacgggagggagacttggtcaatctggcggcgccagccaggagggcgaggggtgtggggaggaacaggcatcatggccctgtggagttgcctgactctctttttttttttttttgagacggagtctcgctctgtcgcccaggctggagtgcagtggtgcgatctcagctcactgcaagckccgcctcccgggttcatgccattctcctacctcagcctcccaagtagctgggattacaggtgcccgccaccacgcccggctaattttttgtatttttagtagatacggggtttcaccatgttagccaggatggtctcaatctcttcacctcgtgatctgcccgcctcggcctcccaaagtgctgcgattacaggcgtgagccactgcgcccggcccttttttttttttttaaactaatatttatcaaggaggcaccagctgccaggctgtgtgaagagcttccacacagcacctcattgg

SEQ ID NO: 206491 - DNA, 601 bp, Human
agagtcccaggctcactctggctggagggagaggcccacttaggggagttgaaggcttccctagcttcctatgaccagagaagtttgtaatcctggaggcctgtctgtgcaagggcctgggggtgactctgggggcgtccaggatagattgcctgagagtgggggtcaccagatggtgaagtgttgtgactggcaaatacagaaagccaggagtgtgtgtcctttgtccgcctctcttccctcaggtctcctgttctttgagattacactggtgaccatactacatggatgtgcgggtggytagattcctgggtgggagggtggatggatggatggacggacgggtaagtgaaaggatggatggatggatagatggacagtggcagctgcatagtctgccagtgccccagacacagcagtcccaccagaaagctctcgggtggcagaaagtgctgctggcagccagactgccaggccacatgcctgattaaggctccgcccctcaccagctggccccacatccctgtgggctgccatgtcccttcctgcaaaccacagacctggaagctcccacttgaagctggggccggcccaggcccca

SEQ ID NO: 206492 - DNA, 601 bp, Human
gcaggggcggaggtcagggtcctggccagggcccctcaatccctcagaggcttcactgggctcccccgggtggatggaggggcccggcatgctcactgtgggggcctggggtactcacgcgtgtgcgagtagatgtaccagagtgcagcagtgagcagggccccgatgaggaaggcaccaaaggtgatgcccagcacggcgggcaggacgaggcctttgcttgtgcaacctagagagggccgacgccatcagcactgccactctgcccctgccccatcccctaccctgttgtgctggcccrtgtgggctttggtgccagctctgctcagccatggaccctcgacttctctgaacctcagtctcctcttgcagcaaacgggctcatcacagccaggcctggcattgagccatggttgctaggactgtccacctagagggcccagccaggccttttgggtcatgcctctgcccctcaaggctgatggagatggcgttttcagggaggatggatggggtaacgtgaggaaactgaggctcgggagtacagagcctgccccacctgctgcatgaccttgggtcaaccctgcccctctctgaggcc

SEQ ID NO: 206493 - DNA, 601 bp, Human
ctgggctctgtactgcgctcactcttgaccactttcccctctttctcacccagttccccattacagccttgcgggagatcaagatccttcagcttctaaaacacgagaatgtggtcaacttgattgagatttgtcgaaccaaaggtaagttatttggttcttacgagaagatgacacttgtagcctaaggttttgtttgtaaacttggaactaggcacacctaaactgcctcttcttaactcagatggacccatggtgactgctttttctggtcctctttcatcgtagctggtgcttcctyggggcctgccctggcccagaagaggcactcagaaaatatttgaccggtgaaggaaggaacagacagatgctctggagggcatgggtgcccgtgggttggagcaggaagaaagaagctggttgtgggaaagtgtgttgggtgtggttttcttgactttttcttctttctattcctgcctcagcttccccctataaccgctgcaagggtagtatatacctggtgttcgacttctgcgagcatgaccttgctgggctgttgagcaatgttttggtcaagttcacgctgtctgagatcaagagg

SEQ ID NO: 206494 - DNA, 601 bp, Human
cctccctgtgggtgcctggaccccggggccggtcacctctggctctcagatcgtcttctctgcgggggtcactcgaggagcagcagcccatggtcccgtcctgccgtgtctcctgtgcaccctgcccttcccctctcaggccctgggccggcccatcacccgcctcccccggcagtgggggcttagcaaccacaacatatgttgccatggagacagttgccggggtggagggctgtggtgggcatgtggaactcttgcccagagagggcggtgagcttggctccaacctctgtctcgtccygcctgctgttagatcccagcaaggccacagccccactgggcagagggaaactgagctcgagagagggaaggcctgctcaagggatgtcagaaccaaaaccagaacccaagctccccactgggctttcaggctcccccgcttcccagggaaatagaggaccaggctgtatcccaccttgctgtgtgacttaggaaaggcctgcccctctctggttctctgccccttccccagggaggaggtgggctgggcggctcccaggggccctcccagccataaggctggagccctacaggagctgtc

SEQ ID NO: 206495 - DNA, 601 bp, Human
atctggggagttagggaagtctgaaagctgaagaggaaagaatattccaggctggaaggagtatggctagtctgaggggacagaggccagggtggctgaaggatggagggaagggagagagttgggggcagggcagagtcctgcaaggtcttgggagcttctggaaggaactttctgtccagggcaatggggaaccacagaagggtttggagccgggggcggttacggtcagctttgcctgtgtgccgtgggctttgctgctggtgggacacccactcagggctactgtcatcccctgccyctcaccccaccagggcccactcaccagtggaaccagctgccccttctccatgatttccgacagcttcttgcccctggccgagcctgagctgacctcggaccgcaggaggtccccggtggagaggtgggtgtagccatacttctgcacgatcttctcacactgggtgcccttccctgagccaggcccacctgcaaacgcccacccattcataaaccccgagacacagggtcccaggaggaacaggggctgccagggtctcccagagagggaggggcagagcccagggtgcagccccaggcc

SEQ ID NO: 206496 - DNA, 601 bp, Human
tcaagtgatctgccctctttggcctcccaaagtgctaggatctcaggcgtgagccactgcacccggccgactttcattaactctattttctagatgtggccctgagggtcacaggtggtaccacacagctggtatgtgtgagccaggccaggacatctttcagaactgtggcacctaacacagggtcaggggtctgaggtctgaaggaatccagctaacccccatttcagatagggaaggtgaggggcagagtggggtagacactttcctgaggtcttgcagccactcatgcagccactcrgaggtcagaaaatatggcctcctatccccagatgaggctggaagctacggaagcccagaaggccctacgagacggggcatgggaatggggcatggggatgggagtcttatcctgccccagcccaccaggatgctggttaggctccccctagcccttgccgacctctccctcctaggcccttgcagtcccgtttatttctcccatacagccttgtgacaccgaggtaaaagtgtatgtgtgtgcacagggccatgtgtgcgagcacgtgtgcattcctgcatatgtgtgctgcgtccgtga

SEQ ID NO: 206497 - DNA, 601 bp, Human
cccagtactccccgcctcctggaacaggctcttccagcgcctttatctttccttaagcaggtctcccaagggcccctgagggcagggaggcacttgtctcacaattctggggtcctttgacaaaggaacaagggatgagggaaggggtgaggggctgctgagtcctggggggttctgagcaatgtccgtgtcattggaacagcatgtcatccatgtcatccatgggacgccttggaaaggcaagaggaataaggttctgcagcccctgcctcgctcaatccagctaccacagctgcctggytgggagggcagagccaccccagagtcacccatgactgccacagctttaggaatgggattgggaccttcaaaccctgtctcctgcttccaactgcctgggccagcccccaagggtttctgcgcagctttggccctggacccctgtcaaggccttggggcactgcctctcaggtcaggctgtttcgtgcctctgtccagctgtgtaaccaagaggcttgtccaaggccacacagctggacagaggcgagaagcagcctgacctccggcgtcagactgacctggacccaggctcacccctgcc

SEQ ID NO: 206498 - DNA, 601 bp, Human
tgtgctcatgctgttccctctgctaggagccctctcccccgagcctgatcctaactcgccttcacctcaataccaagcatcaggtttcagtgcgaagctcacttcctcagggcagtctctctgatgccaccccccgccccccagtactccccgcctcctggaacaggctcttccagcgcctttatctttccttaagcaggtctcccaagggcccctgagggcagggaggcacttgtctcacaattctggggtcctttgacaaaggaacaagggatgagggaaggggtgaggggctgctgartcctggggggttctgagcaatgtccgtgtcattggaacagcatgtcatccatgtcatccatgggacgccttggaaaggcaagaggaataaggttctgcagcccctgcctcgctcaatccagctaccacagctgcctggttgggagggcagagccaccccagagtcacccatgactgccacagctttaggaatgggattgggaccttcaaaccctgtctcctgcttccaactgcctgggccagcccccaagggtttctgcgcagctttggccctggacccctgtcaaggccttggggcact

SEQ ID NO: 206499 - DNA, 601 bp, Human
cctgctcaaacctacaccatggctccccagtgccctcaggagaaagtccacactacttgccagactgagagagcctgactctctctgctctaggctctcatcaacctccttccatgccagacctgtgctcatgctgttccctctgctaggagccctctcccccgagcctgatcctaactcgccttcacctcaataccaagcatcaggtttcagtgcgaagctcacttcctcagggcagtctctctgatgccaccccccgccccccagtactccccgcctcctggaacaggctcttccagcrcctttatctttccttaagcaggtctcccaagggcccctgagggcagggaggcacttgtctcacaattctggggtcctttgacaaaggaacaagggatgagggaaggggtgaggggctgctgagtcctggggggttctgagcaatgtccgtgtcattggaacagcatgtcatccatgtcatccatgggacgccttggaaaggcaagaggaataaggttctgcagcccctgcctcgctcaatccagctaccacagctgcctggttgggagggcagagccaccccagagtcacccatgactgc

SEQ ID NO: 206500 - DNA, 601 bp, Human
accttcaatcccttccccaaggcagcctgaaagaccttcctaaaaccaatctttcctgccactcccctgctcaaacctacaccatggctccccagtgccctcaggagaaagtccacactacttgccagactgagagagcctgactctctctgctctaggctctcatcaacctccttccatgccagacctgtgctcatgctgttccctctgctaggagccctctcccccgagcctgatcctaactcgccttcacctcaataccaagcatcaggtttcagtgcgaagctcacttcctcagggsagtctctctgatgccaccccccgccccccagtactccccgcctcctggaacaggctcttccagcgcctttatctttccttaagcaggtctcccaagggcccctgagggcagggaggcacttgtctcacaattctggggtcctttgacaaaggaacaagggatgagggaaggggtgaggggctgctgagtcctggggggttctgagcaatgtccgtgtcattggaacagcatgtcatccatgtcatccatgggacgccttggaaaggcaagaggaataaggttctgcagcccctgcctcgc

SEQ ID NO: 206501 - DNA, 601 bp, Human
tgctcactactgtgtcccagcacccagttcagtgacccacaccccacacaggcagctcagcatttgtcaatcttggttgattgcaaaagaaggcacggagtggcacaccaggaagggtggtagctgtgggagcatggagcaaggagaaacagctgccagccaggaccctgggaatcagagaaggcctcctggagaaaaagcggctgtacttgagaggcgccttagtggtggtggaaggagatgaatccaaccagaaggcacagcatcagcaacaaaggcatggagtccagggctgggcgcrgtggctcacacctgtgatcctagcactttgggaggccgaagtgggtggatcacttgacctcaggagtttgagactaacctgggcaacatggcaaaaccccgtccctaccaaaatacaaaaaagttagccaggcatggtggtgcacacctgtggttccagctacttgggaggctgaggtgggagcatcatttgagcctgggaagtggaggttgcaatgagctgacattgcatcactgcactccaacctgggtgacagagtgtgacgccatctcaaaaaaaaaaacaaaaaaacaaaggtgg

SEQ ID NO: 206502 - DNA, 601 bp, Human
tgtactatggattccgcatgcggcccaacgacatcgtctatgactgcctccccctctaccactcagcaggtaactctagggctgtcacacagcctccagcacctgccaggtctctaggaaccccacccccatcaggcagtgtgctgcagtagaaacacacagctttgggccaggcgcagtgactcacacctgtaatcccagcactttgggaggccaaggtgggcggatcacttgaggccaggagttcgagaccagcctggccaacatggcaaaaccccatctctactaaaaatacaaaaaktaggctgggtgtggtggctcacacctgtaatcccagcactttgagaggccaaggtgggcggatcacttgaggccaggagttcgagaccatcctggctaacacggtgaaaccccgtctctactaaaagtacaaaaaattagccaggtgtggtggctcatgcctgtaggcccagctactcgggagggtgaggcaggagaatggcgtgaacccgggaggtggagcttgcagtgagccaagatcgtgccactgcactccagcctgggcaacagtacaagactctgtctcggaaaaaaaaaaaag

SEQ ID NO: 206503 - DNA, 601 bp, Human
cacagctttgggccaggcgcagtgactcacacctgtaatcccagcactttgggaggccaaggtgggcggatcacttgaggccaggagttcgagaccagcctggccaacatggcaaaaccccatctctactaaaaatacaaaaattaggctgggtgtggtggctcacacctgtaatcccagcactttgagaggccaaggtgggcggatcacttgaggccaggagttcgagaccatcctggctaacacggtgaaaccccgtctctactaaaagtacaaaaaattagccaggtgtggtggctcrtgcctgtaggcccagctactcgggagggtgaggcaggagaatggcgtgaacccgggaggtggagcttgcagtgagccaagatcgtgccactgcactccagcctgggcaacagtacaagactctgtctcggaaaaaaaaaaaagaaagaaattatctgggtgtggtggcgtgtgcctgtagtcccagctatctgtgaggctgaggcacgagaattgcttgaacctgggaggcaaaggttgcagtgagctgagatcacgccactgcattccagcctgggcaacagagcgagacactgtctca

SEQ ID NO: 206504 - DNA, 601 bp, Human
ggccaggcgcagtgactcacacctgtaatcccagcactttgggaggccaaggtgggcggatcacttgaggccaggagttcgagaccagcctggccaacatggcaaaaccccatctctactaaaaatacaaaaattaggctgggtgtggtggctcacacctgtaatcccagcactttgagaggccaaggtgggcggatcacttgaggccaggagttcgagaccatcctggctaacacggtgaaaccccgtctctactaaaagtacaaaaaattagccaggtgtggtggctcatgcctgtagkcccagctactcgggagggtgaggcaggagaatggcgtgaacccgggaggtggagcttgcagtgagccaagatcgtgccactgcactccagcctgggcaacagtacaagactctgtctcggaaaaaaaaaaaagaaagaaattatctgggtgtggtggcgtgtgcctgtagtcccagctatctgtgaggctgaggcacgagaattgcttgaacctgggaggcaaaggttgcagtgagctgagatcacgccactgcattccagcctgggcaacagagcgagacactgtctcaaaaaaaaaaa

SEQ ID NO: 206505 - DNA, 601 bp, Human
atgcaggagaatggcatgaacccggaaggcggagcttgcagtgagccgagatggcatcactgtactccaggctgggcgacagagcgagactccgtctcaaaaaaaaaaaaaaaagttgttttaaattgaaaaaaggatgagcacaccagcctcacagtgtgtgtggcagtgtcccacggggcatctgggcctgtctcatttcagtttgtttccacagatatgcatggcattgctgcttgtttgtaggggcttaagggaagacagcttgaataaatatagctcctgccctccaggtgcttaragtcgggtgtatatgtgagtgtaggagagaggcagggagcaagagggcagcaccagggaagagcctggtgatggaagccggggaggcttcttggaggaggtcacccaaggcaggcagatgtgaggtgcagaagcctgcagggcagcacaagcctgcctggctggatggcagtatcactgatttggggccggggagggtcttcatctcgctgaccctcaggggccatccctctgcctccaggaaacatcgtgggaatcggccagtgcctgctgcatggcatgacggtggtgattcggaaga

SEQ ID NO: 206506 - DNA, 601 bp, Human
cccagattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgcggccaggttggggatgggcgaggctgctgcagggatggcccacagaaggcactggatgcagaggggagggcagagttcgagygtgagagtgtgggtgctggagtcccacttccccctcattgtccagttttgggcccatggtgagagagcccaggcccaagtcttggccttcgcaggtgggggcctgtggtttcaatagccgcatcctgtccttcgtgtaccccatccggttggtacgtgtcaacgaggacaccatggagctgatccgggggcccgacggcgtctgcattccctgccagccaggtctgccacttcggggtcagagagggaggggttggcctgggaaggaaggaggccaggcgcgtgtggatggggagccttg

SEQ ID NO: 206507 - DNA, 601 bp, Human
ttgttaggctgtccccaaggagcctgacttatgttcatcctcccatcagtttcgagaacaaacatcactggctcagtgtgtccgacctgccaagatgagctcctgggctgggggagggtggggcatttctgtggcaagcagcatgactcaaatcagatcaagacacagagtacaggctgggagtggtggctcacacctgtaatcccagcactttgggaggccgaggcgggtggatcacctgaggtcaggagttcgagaccagcctggcaaacaggatgaaacccatctttactaaaaaataaaaaaaaaaaattagctgggcctgttggcgtgtgcctgtaatctcagctactcaggaggctaaggcaggagaattgcttgaacccaggaggtagaggttgcagtaagccaagattgcactgctgcactccagcctgggcaacaagagcaaaactccgtctcaaaaaaaaaaaaaaaaaaaaagacgcagggtacacctggtgacaggacgggtgggagaggctgcctagggcagatctgaccctgccttccccaccccaggtgagccgggccagctggtgggccgcatcatccagaaaga

SEQ ID NO: 206508 - DNA, 601 bp, Human
agggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggtgtgtccctcccctgctccagctctcggatcccaggtcccttcccgtttccttctggagagacccggttggctgttacttgacctctgcacacagcctggccgggcagttggtaaagtgacctgcctgtgtagaggtgagcagacggggctggcagagaagacacacattgttccttagtagaacacatattaggtgccaggcacagcgctaagcctcgggatacggctggtgagctctggatgttttgccttcttggagttttagagcaggagagaggctggcctaggacaaggcattccaaaggtaaagaatcgaccacataatctgtcatgagattagagttaaacagataaaaagaaaaatgaaccacagagcaagctgataggaaagcaaaaaggtgggacgcttgggatgactagaaggctcctctgaggaggggatggttcagctgagacct

SEQ ID NO: 206509 - DNA, 601 bp, Human
gaaggagcttgggtgctggaggaacgaaagggggcccccaaggctggagccaagtgagaggggcaggcagtggcatgaagtgggagagaaaccagcaggggccagaagcccagggccttgcaggccagggtaagagtcgggactgtcccgggggcagtagggagccacagaagcatctcagcaaggccgggcgcagtggctcatgcctgtaatcccggcactttgggtgggaggccaaggcgggcagatcacttgaggtcaggagttcgagaccagcctgcccaacatggcaaaaccccgkctccactaaacatataaaaattagctggctgggcgtggtggctcacgcctgtaatcccagcacttaggaggccaaggtgggcggatcatttgaggtcaggagttcgagaccagcctggccaacatggtgaaatgccatctccactaaaaatacaaacataaaaataaaaaaattaggctgagcatggtggctcacacctgtaatctcagcactttgggaggccaaggcagatggattgcctgagctcaggagtttgagaccatccagggcaacatgatgaaaccccgtctctaccaaaaa

SEQ ID NO: 206510 - DNA, 601 bp, Human
ggagtgcctaaagcatcggggagggtttaggacttcagtgtggttctgaaggttggagacactgtggccaggctaatggccaagaccatgagcttccggaggattgagcagcaccatacttctgtccaggaaaggcagggaggctctcagaccttgtatttcagatgggctttgctgcagaacaaaccacccccaaacttacttgccccaaaatggctcgaaacaaccagtttattgatgcataattctgtgggtaagcaatttaggggttaagtgcagctgagcagttcttctattgacyttgctttggggtcatcacttagtaacttagctggggcaagaggcagttagatggcctcacccacgtgtctggctctcggctgcttacctctgcagcactgtccaacagaactttctgcagcgatggaaatgttctaggtttctgctgtccaacacagtagccactagcctggcagagctactgagcacttgaaaggtggctgctggctggacgccgtggctcacgcctgtaatcccaacactttgggattaaattttgtttaattaacttaaatttatttatttatttgagatggagtct

SEQ ID NO: 206511 - DNA, 601 bp, Human
cactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgytgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggact

SEQ ID NO: 206512 - DNA, 601 bp, Human
tgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaycccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctggactgatggcctcctgctcctgccccttcaccagtgcaggcccagcctgggccctgctgcccagctagaggggctcatggttccaagc

SEQ ID NO: 206513 - DNA, 601 bp, Human
cctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaccccmtctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctggactgatggcctcctgctcctgccccttcaccagtgcaggcccagcctgggccctgctgcccagctagaggggctcatggttccaagctggg

SEQ ID NO: 206514 - DNA, 601 bp, Human
ccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaargaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctggactgatggcctcctgctcctgccccttcaccagtgcaggcccagcctgggccctgctgcccagctagaggggctcatggttccaagctgggcggcccagaggtgccacagggacagagctggaggggtggctcctagggccattcctgggttg

SEQ ID NO: 206515 - DNA, 601 bp, Human
aggtgaagagactcaggaagagcgttgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactsagaaccgcctcttcccccaggactcccttctggactgatggcctcctgctcctgccccttcaccagtgcaggcccagcctgggccctgctgcccagctagaggggctcatggttccaagctgggcggcccagaggtgccacagggacagagctggaggggtggctcctagggccattcctgggttgtgcctcttatcagtcccttgcagttccaggggaagtggtatgtggtaggcctggcagggaatgcaattctcagagaagacaaagacccgcaaaagatgtatgccaccatctatg

SEQ ID NO: 206516 - DNA, 601 bp, Human
gtgagagaacaggcgcagggtgaagaggcagggagccagggatcagccgcccccagtgggtttctgactctggcagctgagtggattgggattggggcatttgtggagcaaggagcagaatacagacaggttggggagctcagccctggggtgccaggggatgggaagtgggaggactcaaggatggggtcaggtttgacccgagagctaggggaacggctggcatggagcagactggaagtaccgaggtggatccccgggagagggtataggaagggaagcagcaagctgagtgcagggkagaaatgcagggtttctgtgtgttgggtggcggcgggggtgaaagccacccagggaggcagccaaaggaaagaaggacatcgggtgctggagggtctgagtggggtccaggggccccaggcaggccaggagggacagcctggtgtcagctcagggagaaggcccaggcccatctcggctgggtggggtagggcccctccaggtagtgggggatgagctgtcacgggttgggccggactgagagcaacagaaccctgctgctgccctggccccaccttgtccagcacaggaggcccaagcc

SEQ ID NO: 206517 - DNA, 601 bp, Human
atggagcagactggaagtaccgaggtggatccccgggagagggtataggaagggaagcagcaagctgagtgcaggggagaaatgcagggtttctgtgtgttgggtggcggcgggggtgaaagccacccagggaggcagccaaaggaaagaaggacatcgggtgctggagggtctgagtggggtccaggggccccaggcaggccaggagggacagcctggtgtcagctcagggagaaggcccaggcccatctcggctgggtggggtagggcccctccaggtagtgggggatgagctgtcacrggttgggccggactgagagcaacagaaccctgctgctgccctggccccaccttgtccagcacaggaggcccaagcctgggttgtctcccctctcacccacccatctctccctcccaaggaaaaagaagtgtgactactggatcaggacttttgttccaggttgccagcccggcgagttcacgctgggcaacattaagagtgagtcttgagtgaggtggggcactgagttggggctccggggagctgggtaggggcacagaccttcctgcccctccacacagatgtgttgtatggggagaa

SEQ ID NO: 206518 - DNA, 601 bp, Human; identical to SEQ ID NO: 26769

SEQ ID NO: 206519 - DNA, 601 bp, Human; identical to SEQ ID NO: 26768

SEQ ID NO: 206520 - DNA, 601 bp, Human; identical to SEQ ID NO: 26767

SEQ ID NO: 206521 - DNA, 601 bp, Human; identical to SEQ ID NO: 26766

SEQ ID NO: 206522 - DNA, 601 bp, Human; identical to SEQ ID NO: 26765

SEQ ID NO: 206523 - DNA, 601 bp, Human; identical to SEQ ID NO: 26764

SEQ ID NO: 206524 - DNA, 601 bp, Human; identical to SEQ ID NO: 26763

SEQ ID NO: 206525 - DNA, 601 bp, Human; identical to SEQ ID NO: 26762

SEQ ID NO: 206526 - DNA, 601 bp, Human; identical to SEQ ID NO: 26761

SEQ ID NO: 206527 - DNA, 601 bp, Human; identical to SEQ ID NO: 26760

SEQ ID NO: 206528 - DNA, 601 bp, Human; identical to SEQ ID NO: 26759

SEQ ID NO: 206529 - DNA, 601 bp, Human; identical to SEQ ID NO: 26758

SEQ ID NO: 206530 - DNA, 601 bp, Human; identical to SEQ ID NO: 26757

SEQ ID NO: 206531 - DNA, 601 bp, Human; identical to SEQ ID NO: 26756

SEQ ID NO: 206532 - DNA, 601 bp, Human; identical to SEQ ID NO: 26755

SEQ ID NO: 206533 - DNA, 601 bp, Human
atcccccaggacaggctcacggaggtcatcgccagcatcatcaaaccccagaacacgtactgcgtgcgtcggtatgccgtggtccagaaggccgcccatgggcacgtccgcaaggccttcaagagccacgtaaggttcacgtgtgatagtcgtgtccaggatgtgtgtctctgggatatgaatgtgtctagaatgcagtcgtgtctgtgatgcgtttctgtggtggaggtacttccatgatttacacatctgtgatatgcgtgtgtggcacgtgtgtgtcgtggtgcatgtatctgtggcrtgcatatttgtggtgtgtgtgtgtgtggcacgtgtgtgtccatggtgtgtgtgcctgtggtgtgcatgtgtgtgtgtctgtgacacgtgcatgttcatgctgtgtgctgcatgtctgtgatgtgcctatttgtggtgtgtgtgtgtgcatgtgtccgtgacatatgcgtgtctatggcatgggtgtgtgtggccccttggccttactccttcctcctccaggcatggtccgcaccattgtcctcacgctctcgggtgctggtttggggagctccacattcagggtcctcacttctagcat

SEQ ID NO: 206534 - DNA, 601 bp, Human
gctcacggaggtcatcgccagcatcatcaaaccccagaacacgtactgcgtgcgtcggtatgccgtggtccagaaggccgcccatgggcacgtccgcaaggccttcaagagccacgtaaggttcacgtgtgatagtcgtgtccaggatgtgtgtctctgggatatgaatgtgtctagaatgcagtcgtgtctgtgatgcgtttctgtggtggaggtacttccatgatttacacatctgtgatatgcgtgtgtggcacgtgtgtgtcgtggtgcatgtatctgtggcgtgcatatttgtggggtgtgtgtgtgtggcacgtgtgtgtccatggtgtgtgtgcctgtggtgtgcatgtgtgtgtgtctgtgacacgtgcatgttcatgctgtgtgctgcatgtctgtgatgtgcctatttgtggtgtgtgtgtgtgcatgtgtccgtgacatatgcgtgtctatggcatgggtgtgtgtggccccttggccttactccttcctcctccaggcatggtccgcaccattgtcctcacgctctcgggtgctggtttggggagctccacattcagggtcctcacttctagcatgggtgcccctgtcc

SEQ ID NO: 206535 - DNA, 601 bp, Human
catgcggtgctcagaggcgcacacaccctactgagaactgtgcgtgagaggggtctagattctgtgctccttatgggaatctaatgcctgatgatctgaggtggaaccgtttgctcccaaaaccatccccttccccactgctgtcctgtggaaaaatcgtcttccacgaaaccagtccctggtaccacaatggttggggaccctgtgctaaagacctgcttcagcagcctctcgtcagtgttgatatattggcttttctgtgttgagtccagaataattacggatttctgtgatgctttcygccgacctcagacccatgggctatttgtgggcgtgttgcctgctcctgggttgggaagggtgcaggccccatgtaccttcctgttactgccttccaggttggttctcagggttgaatcgtactcgatgtggttttagcccacggccctgccgccagctcctgggggctggggaacatgctgaagcacagagtcaccgtgcgcgtcttttgatgcctcacaagctcgaggcctcctgtgtccgtgttagtgtgtgtcacgtgcctgctcacatcctgtcttggggacgcaggggcttagca

SEQ ID NO: 206536 - DNA, 601 bp, Human
gtggatggcggttggtcccgggggtctgatgtgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtagggtctcatgtggtgactgtggatggcggtcgtggggtctgatgtgtggtgactgtggatggcggtcgtggggtctgatgtggtgactgtggatggcggttgtggggtctgatgtgtggtgactgtggatggcggtcrtggggtctgatgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtggtgact

SEQ ID NO: 206537 - DNA, 601 bp, Human
ggtgactgtggatggcggtcgtggggtctgatgtgtggtgactgtggatggcggtcgtggggtctgatgtgtggtgactgtggatggcggtcgtagggtctcatgtggtgactgtggatggcggtcgtggggtctgatgtgtggtgactgtggatggcggtcgtggggtctgatgtggtgactgtggatggcggttgtggggtctgatgtgtggtgactgtggatggcggtcgtggggtctgatgtggtgactgtggatggcggtcgtggggtctgatgtggtgactgtggatggcggtcrtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtggtgactgtggatggtgatcggtcacaggggtctgatgtgtggtagctgcaggtggagtcccaggtgtgtctgta

SEQ ID NO: 206538 - DNA, 601 bp, Human
ggcggttgtggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtggtgactgtggatggtgatcggtcacaggggtctgatgtgtggtagctgcaggtggagtcccaggtgtgtctgtagctactttgcgtcctcggccccccggcccccgtttcccaaacagaagcttcccaggcgctctctgggcttcatcccgccatcgggcttggccgcaggtccacacgtcctgatcggaagaaacaagtgcccagctctggccggggcaggccacatttgtggctcatgccctctcctctgccggcaggtct

SEQ ID NO: 206539 - DNA, 601 bp, Human; identical to SEQ ID NO: 26754

SEQ ID NO: 206540 - DNA, 601 bp, Human; identical to SEQ ID NO: 26753

SEQ ID NO: 206541 - DNA, 601 bp, Human; identical to SEQ ID NO: 26752

SEQ ID NO: 206542 - DNA, 601 bp, Human; identical to SEQ ID NO: 26751

SEQ ID NO: 206543 - DNA, 601 bp, Human; identical to SEQ ID NO: 26750

SEQ ID NO: 206544 - DNA, 601 bp, Human; identical to SEQ ID NO: 26749

SEQ ID NO: 206545 - DNA, 601 bp, Human; identical to SEQ ID NO: 26748

SEQ ID NO: 206546 - DNA, 601 bp, Human; identical to SEQ ID NO: 26747

SEQ ID NO: 206547 - DNA, 601 bp, Human; identical to SEQ ID NO: 26746

SEQ ID NO: 206548 - DNA, 601 bp, Human; identical to SEQ ID NO: 26745

SEQ ID NO: 206549 - DNA, 601 bp, Human; identical to SEQ ID NO: 26744

SEQ ID NO: 206550 - DNA, 601 bp, Human; identical to SEQ ID NO: 26743

SEQ ID NO: 206551 - DNA, 601 bp, Human; identical to SEQ ID NO: 26742

SEQ ID NO: 206552 - DNA, 601 bp, Human; identical to SEQ ID NO: 26741

SEQ ID NO: 206553 - DNA, 601 bp, Human; identical to SEQ ID NO: 40338

SEQ ID NO: 206554 - DNA, 601 bp, Human; identical to SEQ ID NO: 40339

SEQ ID NO: 206555 - DNA, 601 bp, Human; identical to SEQ ID NO: 40340

SEQ ID NO: 206556 - DNA, 601 bp, Human; identical to SEQ ID NO: 40341

SEQ ID NO: 206557 - DNA, 601 bp, Human; identical to SEQ ID NO: 40342

SEQ ID NO: 206558 - DNA, 601 bp, Human; identical to SEQ ID NO: 40343

SEQ ID NO: 206559 - DNA, 601 bp, Human
aagggacttggataggaaaaagtaatacaaattcagcatccacatggtatacagagaatagtgcttttcataggtacacaggcagagtcatagcttacatacatgggcacgcatttaaccacaggacttatgtatggctgttcagattcaaacttctaaccagatattctgggtctaaaaaggaccacagagatcctctgatccagcccactgccttatataggatgtacctactggcccagagagaagagtctgttcaaagccattcaaaggaaaaaaaagaggacacaattttaattcsgttgctcaataactctatcaaaaaataaaaagcaattcaaaatgataaaaggaacacaggtggttacaagatccagaaacaaatccaaaatatcaccatttagtatacataacatctcagtccctcagtttccacatagcacaatgggaatatgttagcttccctgtctacttcagagtgttattgggagaatgtaatgaaattatgtatgtgaacatactctttattgttaaagataaggctaaagcagggcagtagtattaggaagcacttattttaacaagttaaatttcttttctg

SEQ ID NO: 206560 - DNA, 601 bp, Human
ttttttgtacagaaatattcatagcatctttatgtgtaacagtaaaaaatactaaaaccaaccccaatgccctttagtgggtgactagatgaacaaattttggcatatccttatcataaattactactcaccagtaaaaacaaaacaactattgatacacagaacaccttgaatggatcttagattaatttgcttaaggttaaatagctaatctcaaaaaggtacagtgtatttttttgttgttttttctaagtaaatctgtcaaaatttgactaaaattcaggactccaagctagagccrggagcacagatccatggaactttcattataaagttttctttatgtgaggtgatgaatacgttaatttacctgattgtggtaattatttcacaatgtatatgtatatcaaaacatcacattgaacaccataacatacacaatttttatttgttaattatatttcaataaagctgaaaaaaaaagaaaggaaggaaggaaggttaacttctaaattggtctacacagtaggctttgtaagtgaaacagtggatcacgtagaagtatgatgaaggaggtcaaggagacagaatgtgtaaaata

SEQ ID NO: 206561 - DNA, 601 bp, Human
catatgactgaaaatagcatttcatacatccaacattcatttcttttttaactatttgatagctcaatatccatctccccaactagaatgggagtgcctcaccacaggccatgtctgtgtcttgcaccaaggctggcatagagtaagtgttcagtaaatatttctctagtgaccctccctttgggcttaataagattaagcaaacaccatgctctcaaacgggagagtgtggaacaattaatggaagtgtggcatcaacacagtgaagaggaatatgagaactgactggagggaagctacytattttggtgaaaacaggggacacaaacaactaactctatctatctccctgatatgacagcatgatagagtgaaaacttatgcaggctttgcagtcaaacgtggatgcaaatccgagcttgttagcagtctgaccctgagcaaatacttaccttctcttaaagacacagtttctttttatataaagatatataatgggcatgtatctactgctattttttaaactaggaaatcagaattgcatcaaagtaacttttaacatgcctactttgctaagccatggtaaataagggtgaagtaa

SEQ ID NO: 206562 - DNA, 601 bp, Human
ccagttaagtgtgcagctacatggcatgccaagggacaagatgtctgtaagtttcgctgcaaaccaggatctcaaccttgccaatgaggtgggggaggccaacggctcatctggccttcctgagccaattcagagaggcccagctctgtctctcagctttcctgatgggaggccagagaactttgacgtggttcttgaccacaggcttggcctccactctggctgggaaggaatccacagcttttggaggaggctcagatggtggtccagaaccttgtttttttctcctgctccccacaaraggccccttctccaaccattccaatctatggtaacctccccttcttcaaaaattctacatgatttactgtccatatgactgaaaatagcatttcatacatccaacattcatttcttttttaactatttgatagctcaatatccatctccccaactagaatgggagtgcctcaccacaggccatgtctgtgtcttgcaccaaggctggcatagagtaagtgttcagtaaatatttctctagtgaccctccctttgggcttaataagattaagcaaacaccatgctctcaaacgggagagtg

SEQ ID NO: 206563 - DNA, 601 bp, Human; identical to SEQ ID NO: 112505

SEQ ID NO: 206564 - DNA, 601 bp, Human; identical to SEQ ID NO: 112506

SEQ ID NO: 206565 - DNA, 601 bp, Human; identical to SEQ ID NO: 112507

SEQ ID NO: 206566 - DNA, 601 bp, Human; identical to SEQ ID NO: 112508

SEQ ID NO: 206567 - DNA, 601 bp, Human; identical to SEQ ID NO: 112509

SEQ ID NO: 206568 - DNA, 601 bp, Human; identical to SEQ ID NO: 112510

SEQ ID NO: 206569 - DNA, 601 bp, Human; identical to SEQ ID NO: 112511

SEQ ID NO: 206570 - DNA, 601 bp, Human; identical to SEQ ID NO: 112512

SEQ ID NO: 206571 - DNA, 601 bp, Human; identical to SEQ ID NO: 112513

SEQ ID NO: 206572 - DNA, 601 bp, Human; identical to SEQ ID NO: 112514

SEQ ID NO: 206573 - DNA, 601 bp, Human; identical to SEQ ID NO: 112515

SEQ ID NO: 206574 - DNA, 601 bp, Human; identical to SEQ ID NO: 112516

SEQ ID NO: 206575 - DNA, 601 bp, Human; identical to SEQ ID NO: 112517

SEQ ID NO: 206576 - DNA, 601 bp, Human; identical to SEQ ID NO: 112505

SEQ ID NO: 206577 - DNA, 601 bp, Human; identical to SEQ ID NO: 112506

SEQ ID NO: 206578 - DNA, 601 bp, Human; identical to SEQ ID NO: 112507

SEQ ID NO: 206579 - DNA, 601 bp, Human; identical to SEQ ID NO: 112508

SEQ ID NO: 206580 - DNA, 601 bp, Human; identical to SEQ ID NO: 112509

SEQ ID NO: 206581 - DNA, 601 bp, Human; identical to SEQ ID NO: 112510

SEQ ID NO: 206582 - DNA, 601 bp, Human; identical to SEQ ID NO: 112511

SEQ ID NO: 206583 - DNA, 601 bp, Human; identical to SEQ ID NO: 112512

SEQ ID NO: 206584 - DNA, 601 bp, Human; identical to SEQ ID NO: 112513

SEQ ID NO: 206585 - DNA, 601 bp, Human; identical to SEQ ID NO: 112514

SEQ ID NO: 206586 - DNA, 601 bp, Human; identical to SEQ ID NO: 112515

SEQ ID NO: 206587 - DNA, 601 bp, Human; identical to SEQ ID NO: 112516

SEQ ID NO: 206588 - DNA, 601 bp, Human; identical to SEQ ID NO: 112517

SEQ ID NO: 206589 - DNA, 601 bp, Human
gctgaggcaggagaatctcttgaacccaggaggcggaggttgcagtgagccgagatcgcaccgctgcactccagcctagacgacagagcgggactccgtctcaaaaaaaaaaaaaaaaaaaaattaccaacaaagagttactatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccagsaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataacatttg

SEQ ID NO: 206590 - DNA, 601 bp, Human
cgggactccgtctcaaaaaaaaaaaaaaaaaaaaattaccaacaaagagttactatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccagcaaactaaattgatgacgataaagtaaagctaattgtaattcataactgaaaagcagtactaaaagcaagtgataaccagcagccaacytagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataacatttgccaaaacaaactgaataaaatgaatgcattttgggtccattatctaatatttaatgggaccctttcaccctaccagtaactgcatttt

SEQ ID NO: 206591 - DNA, 601 bp, Human
cccagcaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataayatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgaagatacaatggaaaatattgagggcttggaggaagttggtatatactttgtctttttctttttttttttcttgagac

SEQ ID NO: 206592 - DNA, 601 bp, Human
cagtggagtagcactattagttttcttcaagaactgcactggtgcaagaggcctagcttttgacctgtatccgtttttaacatgccttcctgacttccttagaagcttaatcctttctagcttctgatttaaagtgagagacatgagactcttcctttcacttgtatacttaggggccattgtcgggttattcattagcttaatttcaatattgttgtgtctcaggagtaggaatatccaaagagagggagaaagacttggggagcagctggtcagtggaacactcaggacagaaacagcrtttctttttttttaattaatttatattaaagacagggtcttgctctgtttcccaggctggagtggagtggtgcagacataccttattgcagccttgaactcctgggcccaagcgattcttctccctccgcttcccaagtagctaggactataggcacatgactccatgcctggctaattttttattttttgtacaaatggaggtctcactatgttgcccagactggtcttgaactcctggcctcaggtgatcctctcacctcagcccagcatgctgggattgcagatgtgagccactgca

SEQ ID NO: 206593 - DNA, 601 bp, Human
caggctcccctccacatgcaggcctggggactgatgttatttcatgatgatgcttggtgtcacagaggagcattatctttgttgctcaggatttctactgaagaaatagatagaatagtacaattttagaaaagatgacctatgtgtccagagtggcttcttccccactggcggcagtgaggcaccagcctgcatctattctgcctgaacagttactgtgtagtctcctggctggtgtcagcctccaggtttacgtcttgagtccatctcccacacggccattacagtgatccttctgacstgaaagtaagccttcttattatctatgggataaagtccaaacagcatatacgtatatggccttgcgtgatcttaccccagcccacttctcttactttatgctctaccctcttctccttccagctgcaattcccatttgaatcaaattattgttatactttatgcctttgttttgtctgcttcctgtgcctaaaatgctgttcccaaatgatttcccctgggaaacaccagctcattctgtaagatggatcccacatattacttgtattaattgttttccaattcccactgcccttgcctt

SEQ ID NO: 206594 - DNA, 601 bp, Human
ctggggactgatgttatttcatgatgatgcttggtgtcacagaggagcattatctttgttgctcaggatttctactgaagaaatagatagaatagtacaattttagaaaagatgacctatgtgtccagagtggcttcttccccactggcggcagtgaggcaccagcctgcatctattctgcctgaacagttactgtgtagtctcctggctggtgtcagcctccaggtttacgtcttgagtccatctcccacacggccattacagtgatccttctgacctgaaagtaagccttcttattatctatgggataaagtccaaacagcatatacgtatatggccttgcgtgatcttaccccagcccacttctcttactttatgctctaccctcttctccttccagctgcaattcccatttgaatcaaattattgttatactttatgcctttgttttgtctgcttcctgtgcctaaaatgctgttcccaaatgatttcccctgggaaacaccagctcattctgtaagatggatcccacatattacttgtattaattgttttccaattcccactgcccttgccttgtacctctactgcacttttgaca

SEQ ID NO: 206595 - DNA, 601 bp, Human
ttttcctcttaaaatttgagggcaggcattgtatgttccacatctctgtatttctagcacctagcacagtgcctcgcataggcaagttgccaggtaatgagcaactgaaggaaatactgcaggcaaaaaggcattgaagcaagaaagcagggaaagcaccaagcaccacagaggagtaagtcccagtggaagctcccattggtcccctgaaagctacctgacaatctccttattacctagagaggaaacctaggagtaagtaaaattcagattaaatgacttgtccaaggtcacatggcamgatggcgcagaaccataactagatggggacttcccaaaacccaggccagtataccttccaagtgataccagctaggttaaagttagaaaagtggtttaggtggactccagtatatagaagctgctgccatgtaatcttttttatttttttctcagcacattctactggcagaaactggcagttactagaggttaaataataataaattttaagtcctcttaacatatgaatgccagaagatgaccaaatttgtataggcttgttgctttctaggttttaaaaatgttgtctttactgaaa

SEQ ID NO: 206596 - DNA, 601 bp, Human
cttaaaatttgagggcaggcattgtatgttccacatctctgtatttctagcacctagcacagtgcctcgcataggcaagttgccaggtaatgagcaactgaaggaaatactgcaggcaaaaaggcattgaagcaagaaagcagggaaagcaccaagcaccacagaggagtaagtcccagtggaagctcccattggtcccctgaaagctacctgacaatctccttattacctagagaggaaacctaggagtaagtaaaattcagattaaatgacttgtccaaggtcacatggcacgatggcgcagaaccataactagatggggacttcccaaaacccaggccagtataccttccaagtgataccagctaggttaaagttagaaaagtggtttaggtggactccagtatatagaagctgctgccatgtaatcttttttatttttttctcagcacattctactggcagaaactggcagttactagaggttaaataataataaattttaagtcctcttaacatatgaatgccagaagatgaccaaatttgtataggcttgttgctttctaggttttaaaaatgttgtctttactgaaagtgcatt

SEQ ID NO: 206597 - DNA, 601 bp, Human
aagagtatgactttccaaggttactccataggtacagacaccattcattttagggcacggattatgataaattgattaaaagttcagtttcattactttagcccagtgattctcaaaacgttatcactttccttcctgaggagcctttctagccatttttttctaaacctcttacttttaataccacagatagagtttatgtgctgtatatttgtactttttacatagaagtcgtaagttttttttttttcttagttaccccaaaccaattttcacccatctggaaaggatagcatttctrttgaaagtacatgttttagccctacttttgtatattaagcctaaggtggtaatataaaccagtgataaccaagtctcaccaatcttcagatcgcctgagtggttgattggatggatgggtagttggtcggttttaaataaggattctaggattccacatttaatattttatatcagtctgtagggtaagtcccaagaatgggggacagtgaccgtttttgtttttcaagctgagtaattgtgatcttacagtttcgacaccctggtatagacaatgacttcatggtcagaaaagctttat

SEQ ID NO: 206598 - DNA, 601 bp, Human
gtctgtagggtaagtcccaagaatgggggacagtgaccgtttttgtttttcaagctgagtaattgtgatcttacagtttcgacaccctggtatagacaatgacttcatggtcagaaaagctttatagagattggcttcaaagatggacgagaagggtgttgtggtaaaactctgttagccctgttatagaatgttaatagtgcttcattactacttatataaacacaaaagaaacctgacatactacgtaagctacattataataaaaatcatagtccacgttttcaagtttaggccagtrtatgctctaatttctttttattcctttttttttttttttttttgagacagagtcttgctgtgtcgcccaggccagagtgcaatgacacgatctcagctcactgcaacctctgcctcctggattcaaacaattctcgtgcctcagccacccatgtagctgggattacaggcgtgcaccaccatgcctggctaatttttgcatttttagtagagtcaggatttcgctgtgttgcccaggctggtctcaaactcgtggcctcaaatgatccgccagccttggcctcccagagtgctgggatta

SEQ ID NO: 206599 - DNA, 601 bp, Human
ggggacagtgaccgtttttgtttttcaagctgagtaattgtgatcttacagtttcgacaccctggtatagacaatgacttcatggtcagaaaagctttatagagattggcttcaaagatggacgagaagggtgttgtggtaaaactctgttagccctgttatagaatgttaatagtgcttcattactacttatataaacacaaaagaaacctgacatactacgtaagctacattataataaaaatcatagtccacgttttcaagtttaggccagtgtatgctctaatttctttttattcctttttttttttttttttttgagacagagtcttgctgtgtcgcccaggccagagtgcaatgacacgatctcagctcactgcaacctctgcctcctggattcaaacaattctcgtgcctcagccacccatgtagctgggattacaggcgtgcaccaccatgcctggctaatttttgcatttttagtagagtcaggatttcgctgtgttgcccaggctggtctcaaactcgtggcctcaaatgatccgccagccttggcctcccagagtgctgggattacagacatgagctactgcacccagcc

SEQ ID NO: 206600 - DNA, 601 bp, Human
ttaagaaaattttaatctgtgatgttggcaaaattaaaagatggactctgcccagaattaaccagggtatggagaaataggcactctcacaaattgttagtaggaatataaactagtacaacattttgggagatctttttgaacatatctgttaaaattctaggctgggcatggtggctcatgcctgtaatcctagcactttgggaggctgaggcgggcggatcacctgaggtcaggagttcaagaccagcctagccaacatggcgaaaccccgtctctactaaaaatacaaaaattagtygggcatggtgacacatgcctgtaatcccagctatcggggggctgaggaggagaatcgcttgaacccaggaggcagtgattgcagtgagctgagatcgtgccactgcactccagcaagggcgacagagtgagactctgtctcaaaaaaatacaattccaaatgtttacactcatagacccagtgacttttaagaatttgtcttacagaaacattaggtcaagtttacaaagtagttgcatgagaatatcatttgtaatattttttgttttgttttgcaaattacagcttaagatataattt

SEQ ID NO: 206601 - DNA, 601 bp, Human
actgcactccagcaagggcgacagagtgagactctgtctcaaaaaaatacaattccaaatgtttacactcatagacccagtgacttttaagaatttgtcttacagaaacattaggtcaagtttacaaagtagttgcatgagaatatcatttgtaatattttttgttttgttttgcaaattacagcttaagatataatttacatgctataaaattcacccttttgaagtgaatagttctgtggtttttaacagattcaactattaccactacctaatttcagggtgtgttcatcatcccccmaaaagccccatacccattagcagtcactccccattctcatcttccccctgcctgtggcatccactaatctactttgtttttgtttttttttttaaagagatggaggtctcattctgttgcccaagctggagcacagtggcacaatcatagctcactgccttgaactcctaggctcaggtgatcctcccacctcagcctcctaagtagcaataatctactttgtctctatagatttgactattctggacatttcctataaatggagtcatacgatatgtggccttttgtaactggcttttc

SEQ ID NO: 206602 - DNA, 601 bp, Human
tgaggggtgggcttggtttatctggtgcaaaggccaactaccgtggaggtaagcatttcattctattagggttaatttatcagaagggcgtttccccactagaatagcatattgaggtggaataggcctgaatatttactactgaacagtctcggcatagaattggatggcttgggtgttgtattttgagcatatgttttgtgtgtgtttggggacaggatggcatggggaaagcaccgagccgcagaaaagactcgtgggttaatactgtgttgtaggaaatactggagaatgaaaccartggtgaacaagccattttcttcttccctctatccttaatctggccccaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtgagtctgaacagttggtatctctctttttgctttcaaaggctcagtatt

SEQ ID NO: 206603 - DNA, 601 bp, Human
tatcatacagtaaagtctcattatctttcaggtttctgcatttaatgccagttactcagattctggactctttgggatttatactatctcccaggccacagctgctggagatgtaagttgcaaactcaccaaacttctttcatgaacaagttatttctcccccccgccataaacatgttttcggttaaaatatggaatgtttgaatgcagtgcaatgacttatcagagctctgtatagtatgatgtcattgaagcattatctgctatagggaaatttacacatgtatactaatgcttccakgaaagaggagagaattgcctccttcatgttttggttctggttggacaagttgcattgagttggctctgagacatctaaattgagaacccaggagaggggaagaccaggaggtttatttgcaagtcttcagtgtagagattgtgttgaaatcagggatatgtgtgaatgattgtaggaaaagaaaactaaagctcaatttctgggaaacaacaccatttaaggagcaagtggctaagaaaaatggcccaggtaaacagaaagaaaaagagaagctgatatatttgaaggataggaaagaga

SEQ ID NO: 206604 - DNA, 601 bp, Human
taaaagacaaaaatgatctctgatttccctagcaatgattctgtttccattgattcaaattactaaaaatttaaacaatattcattggtgtgtcaaaatacacttgtgcattttctgcagttataaagatatctttgggcttaaaatatttttgtgtttcgtattactttcttggtgtagattcccaactaagttaagagttataaacataacgaaagactccatgttagagtgtgtgtatgtgtgtatgtttaaataatacatttgactaggcgcagttgctcatacctgtaatcccaggactttgggaggctggggcaggaggatcacttgaggccaggagttcaaccagcctgggtaatgtggcaagacactgtctttacaaaaagatatttaaaactagccaggtgtggtagtgtgtgcctgtagcctcagctactcaggaggctgaagaggggggattgcttgagcccacgagtttgaggctgcagtgaactaagatcacgccattgcacactagcctgggcaacagagcaagaccctgtctcttaaaaaaaaaaaatgtatttctaagtcacaaatctaaagagattgtaccagt

SEQ ID NO: 206605 - DNA, 601 bp, Human
atcattttttaattaagctgacaacgtggtaaaactgcagcattaaattgtaattatgtttaaatggaagtctttctgtagagtgttaaaggatgataaacgtttgaggttcaaataactcgactgtcttatcaaacaccatgtctataagtaataagtttctgggagaattgtgaattggattttgttttatttcaagtggatgcttttgtgcccatatttaagctgccgttgcttacaagacctgtactgcccttccccacctgccttttccatcataccctatgctcacagacaaatmtcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaaatagaatggaggccattagcactgtaagttgttagtttgcctgtttaccaaaaatatgttgagtttcggggcacataccttaaaattgccctgtttcactgtgtaagaggaactggcttgacta

SEQ ID NO: 206606 - DNA, 601 bp, Human
tcccgtctctactaaaaatacaaaaattagctgggcatagtgatacatgcctgtaatcccagctccttgggagggtgaggcagagaattgcttgaacctgggaggcggaggctgcagtgagccaagatcgcagcactgcactccacactgggtgacagagcgagactccacctcaaaaaaaaaaaaaaaaaaaagaatgtcctatccataaattcttgaaatgacaaaataagttcgcctgcttgatgatatatatttttatttttgttaattttgtcttttgtttgtttctttaaaggcrgcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtat

SEQ ID NO: 206607 - DNA, 601 bp, Human
ctgacacacacttgttcaagtattaacatttctcctcagggaactaaggggcaaccaacctattcttcattcaccttcaagttaaacaacttcgttacaaaacaaaacaaaaaaggagggaattaatagcaaaaatagaaggcatttcttatattccagtcagtgtgcaagcaaaatcactggagcaaatcataagttgctggaagagaacaataagtacttcaaggccataatgtgctacttgccctctgtgataagcaaactttagtggcatccaatctaagtttatatcacaggtcartcaaaatcttgcctaaccattagccgttactcacacatatatatgtatatgtattatagttattagtgccagaaatctagtgaccaaaaccactaatctaggaccgtgaacgattctacgcaaactcaccagaagaaattatggatcaataaaatcaatgaaattaaaattttgactgcagagtcaactgaaacaatttcatattcatgagactgttaagaacataaacgcggggttaccttttgcctccttttacagcaaaaggctttatctttgtgctcaaagtatggaacagtttac

SEQ ID NO: 206608 - DNA, 601 bp, Human
tcaaatagatcattgcctaagaggttcctatcccagccttagggaaaaggtatgtgtgtgggtgatggtggtaggttgataagacaaaggaaaacatactgaagaaggtgaggttcctactgaccccttaaaggataaggaagtactagctaaacaaaagagagtggaggatggagaggcattccactaagcctacggggcagcaggcataaaggtttagacagtgagaaacagctgggttgtggcagaaataataaatcctttgtcaacaaagaagccaagacaattcaatggggaaagyatagtgttttcaaaaaatgaagctgggacaagtggacacccacatgcaaaaagaatacgtttcaacctttacctcatactgcatacaaaaaaaaatcaatgaatatgcatcaaagacctaaatataagagctaaaattataaaactcttgggagaaaacacagtagtaaatcctcatgacgctgaatgtttgatatccatattggatagtgagacaataactagttcggattaagaccattctctaacttcggtgtcctcagtaaatggcatagtttctggtatatagaacatgcccgat

SEQ ID NO: 206609 - DNA, 601 bp, Human
cactttttcttcctttcattcttatttacacacaagcagaaatcatgtactttttatttctttcaagaaatcagcaaaaaaattcttaatgccataaatagagttgaaatgctttttaaaaacatttaataccagctacattataattttgatatgtatggatacaaataaaacattatgaaaatgaagtagatcagtttccatttcattaaagtatagaacattttggccaaaaggaatttcaagaagcatctagtgtagggaagtgacttgcctaaagtcacacagctagttcatttgmtgaagtcttataagtaaattgctgcattgcccatccagtgcttgctccactacaccttgtagcctcctcgttcctatcttccagtttgaaattttaaggaggcataaccgcatcacactaactaaactgaacatttatgagaagacacaaatagtttgtattttgaataacagtaaagagaaaaatagggtaaacatttaaacaaagaacttcatgaaatgcttagatttccttgataaatgacataaaaggaacaataaaggcaagagttatagacacagatttttgtctggaaaaaac

SEQ ID NO: 206610 - DNA, 601 bp, Human
ggactaggtcctggctgtaaataagcagatgactgaccaagcatggagactagctgaatatcatcagctctgtctatcatgattattagttgtaagacagacaccttcttttccttattttctattcaaagagaataccctatccctgttaatttgggggagcaaagacacataaggtttactgaggtctctaagtacatcccaggatgttccttctctgggggattgcaggtctaccaatgtggtattaaaatcatagtgtggctgggcacagtggctcacgcctgtaatcccagcacaytgggaggccaaggtgggcagatcacctgaggttgggagttcaagaccagcctgaccaacatggtgaaaccccgtctctactaaaaatacaaaaattagctgggcatggtagtggatgcctgtaattccagctactcaggaggctgaggcaggagaatcacttgaacccgggaggcagaggttgctctgagccgagattgcgccattgcactccagcctgggcaacaaaagcgaaactcccgtctcaaaaaaataaaaataaataataaataataaaatcatagtgtggctgtcaaggtct

SEQ ID NO: 206611 - DNA, 601 bp, Human
ggatgtgctcaggagataattttaaaattatttaacaattggtttagcactggtgacagccaattgagaagagatcctcggactaggtcctggctgtaaataagcagatgactgaccaagcatggagactagctgaatatcatcagctctgtctatcatgattattagttgtaagacagacaccttcttttccttattttctattcaaagagaataccctatccctgttaatttgggggagcaaagacacataaggtttactgaggtctctaagtacatcccaggatgttccttctctggsggattgcaggtctaccaatgtggtattaaaatcatagtgtggctgggcacagtggctcacgcctgtaatcccagcacactgggaggccaaggtgggcagatcacctgaggttgggagttcaagaccagcctgaccaacatggtgaaaccccgtctctactaaaaatacaaaaattagctgggcatggtagtggatgcctgtaattccagctactcaggaggctgaggcaggagaatcacttgaacccgggaggcagaggttgctctgagccgagattgcgccattgcactccagcctggg

SEQ ID NO: 206612 - DNA, 601 bp, Human
tagattttcccttgagtttataggtaagtaaacaaaagtaattatattcaagttaaacaaataatcaggtatcagacagactttaccctgtgagttacaactttcaggacaaactagtaggcagggatattttcatttgaaccagttgcgaattgggctatctaatcctttcagctatatctttattttaataggcagctatgttatcatgcattttgaatttggagtcagatttggagtcagagaattgggttcctgtcctaattctgtacttactagctctataacctcagataagtcractgttctgtagttcagttttcttatttgtaaaatggggaactttatgggacttatgtgaagataaaaggataacacatacaaaaatgcttggtggataactatcattctattaacagataaaaaatgggcaacccaaaatgtaatgtttctagacttggaccctcctatctgcctctgagagcgaggcgagaaggggcaaaatggttggaaccggacttcactcagaacctctcaacctactcctcacgaaaaatgacaaatagaagcgagtgagggaataaagggagctaacccaata

SEQ ID NO: 206613 - DNA, 601 bp, Human
aaacaagaacaatccaagcccaaacccagcagaagaaaagaaataaccaagatcagagcagaactaaatgaaactgaaacaaacaaacaaaaaaatacaaaagataaatgaagcaaaacgctggttcttttaaaataaataaaattgatagacaattggcaagatgaaccaaggaaagaagagagaagatccaaataagctcaagtagaaatgaaatgggagatattacaactgataccacagaaataccaaagattattcaatgctactaagaacacttacgtgcacaaactagaaaacytaaaggagatggataaattcctggaaatatacaaccctcctacattaaaccaggaacataaagcatctctgaacagaccagtaacaagcagcgagattgaaatggtaacaacaacaacaaaaaatgccaacaaaaaagtgcacaggaccagacgaattcacagttgaactctatcagacattcaaagaagaattgataccaatcttattgacactattccaaaagttagaggaagagggaatcctccctaaatcattctatgaagccaatatcaccctaataccaaaactagggaaggac

SEQ ID NO: 206614 - DNA, 601 bp, Human
tccacataatgggttttcttttaactacccacttgacatttatagtccactttaagggctctgtgcctagagttggcagctctaggaacagtgagatcagtttgtctacagttgttcccaaccttttttggctctggtacacctacacttgcttccaaaaatataccccacagtctggtgctcaatggaatgaaaatctttcctgagctaataggatataaaacagaggaggcagtggacatagttctgcattttagggtactcataacagcatagtgagccaaaccagtgacaatgatgyaattgacccagcacagagagaaagaaggtttgggctgtttcttcaaaactgggatagatttatcaacctacgcctcccagattggcctcccttatgacttagaatatgcttttgaagagctggctggccaagggaaatggtgcagccagtagtagcattagagtaaatgaaaactaactggtttgtacaaggactaaaatcatagttttggcctcattagcactatactctaactttctgagctaactaactacagatattacctgaaagaagaccaacctttaatcagaaacaaaaatg

SEQ ID NO: 206615 - DNA, 601 bp, Human
ctgatgctttttctgatgtgggaagatgccctttagaaatttattcacttcatacattttgggtgtttaactgcaattagctagaagctctgaaatatctttttataattctgtccaccatttctacagagctgcagttgttggagcttctgtaaatttccatggttgttggcaggtcaggacaagggtcatttttctagctgtaactttggcatttaagagcacccctacccaagcctgtagcttttatgatccagggttgggcttagcaagtttcattcttactttcaaacaaggtactttgttttccttattttcagtactagctgatcaaacctcttaagctgttctgggaatgtggtattggtgcttctactgtcgcttcattaaatgatgctatttgtaccattataagtaatttctatgtttaagggcagaaatggttacaggagatcagcaggggaggaaaattcaactgattggtctgaggtgagaggcataccagagatagaaatcatgatggctttcccagaaattggaaatggctaaaattttcagtgttctttctctttttgtatctcttgcccattgaattctcata

SEQ ID NO: 206616 - DNA, 601 bp, Human
ccaaaaatgaaagaaaatcctacttataatagcatcaaaagaataaaatacgtagctatatatatatgtgtatatatatatatatttttttttttttgagaaagtctcattctgttgcctaggctggagtacagtagtgtgaccttggctcactgcaacctccaactcctgggttcaagcgattcttgtgcctcagcctcccgaatagctgggactataggcgcgcatcaccatgcccggctaatttttgtacaattagtagagatggggttttgccatgttggccaggctggtcttgaaytcctgaccgcaagtgatcctactgcttgggcctcccaaagtgctgggattacaggcataagccattgcatccggcccctagcaataaatttagcaaaagaagtgcaagacttgtatactgaaaattatattgttgagagaaattaaagatgatctaaataaatggaaagaagttatgattcttgaaatgtaccttttcaaggggcccgtcatagtagaattatggatggtagttccagtacttgatatatgctgattattacatggaaagatggagaaaacagctgatgctttttctgat

SEQ ID NO: 206617 - DNA, 601 bp, Human
atgtttttattcagtaaaatgtaggttagcaaatcaaaatcttcacttggctatgaatttttcttttatgtactctgtttttagggaaagaagcaaataagaagaaaccaaaaccaaacaggtttccaaaagcagtttcccagggtatatctcaggttcagcccagatttagtcactatcctctatctccaatgatcttattcaatagaagtcagagtacagaaacactgtgtaacttttagtgatagcaagattcaatcaggttcagtccactgtgcttactaaggcaaaaatgtatacrtacattttaaaaagaggttaaagaacatggatagaacaaaaaaagtctgtctagtataactgtccactaagccagaaaattcaattaaccagaaaccccattttctgagaattctagttagttgaaaatatcacttttgattttcacctctcatttaatgaacttaaaaaccttaatggtttagacatcagtactgggtagacgaattaaatgtactctcttcctccacaagaaaaagaacactttaggtataattgatggaaattgtgccggctcaacctttctagttaaaagcaccgg

SEQ ID NO: 206618 - DNA, 601 bp, Human
taggatgcagaaggagagaagagaaaaatatttgctactaacgctttgaattctcaatgtcagcctgagaaaagttattgccagcagcaaaacccctttctaagacataaattttaaacctattgcatttgatgggattgagaggcagactgtgttaaggacccaaagtattactagtcagtcccaaatgggagccgttcaactttccataggtatgttttctctaaattctctcaatcctatctgagctcaggtactgctgactcattctgcaacaactcaacctgccaggggatgcagsatatggtaaatgcctcagtgacttctgaatatctattacaaatggttcagggatgcagggatttgggaggagggaggctgccttgcagtgagcatgatgtgtcattttgttggagaacatgggtgcctcttggacatattcagaagacatttaattttctgtaagtttctttttctgcttttagcatcaaacaagctgtactggttccatgaacttctaaaaacatgaaagaaaaaaaaacaaatccataaaataaaagacaaaccttaaactcccaaaccaaccaaccaaccaaacaac

SEQ ID NO: 206619 - DNA, 601 bp, Human
aaatatctactcccattctgtgggttatctttgcactctcttgatagtgtcctttgcagcacaaagttttaaattttgacgaaattcaatttatctatttcttctttttttgcttatgtttttggtgtcatatccaagagaccacttcctatttcaacatcatgaaaatttacatctatgttttcatctaagagttttatagttttagctcttacatttaagtctttgatctattttaaattaatttttatatatggtgcgaggtaagggtccaactttattttttattttattttatttwtttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaactt

SEQ ID NO: 206620 - DNA, 601 bp, Human
gcaaatatctactcccattctgtgggttatctttgcactctcttgatagtgtcctttgcagcacaaagttttaaattttgacgaaattcaatttatctatttcttctttttttgcttatgtttttggtgtcatatccaagagaccacttcctatttcaacatcatgaaaatttacatctatgttttcatctaagagttttatagttttagctcttacatttaagtctttgatctattttaaattaatttttatatatggtgcgaggtaagggtccaactttattttttattttattttatwtatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaac

SEQ ID NO: 206621 - DNA, 601 bp, Human
caatgaacttgaaggcaaagcaatggaaactcttcaaaatacatcacagggagaaataaaagactgaaaaaaaaaaaaaataggccgggcatggtggctcatgcccataattccagcactttgggaggctgaggcaagaagattgcttgagcccaggagtggcagatcagcctggacaacagcctgggcaacacagtgagagcttgtctctacaaaataaaacaattaaccaggcatggtggagtgcacctgtagtcctatttacctgggagggtgaggtgggaggatcgcttgagcccargaagttgaggctgcagtaagctatgactataccactgcgctcaagcctggctgacggagtaagactctgtctcttaaaaataaagagaaagaaagaaagaaagaaagaaagaaagaaagaaagaaagaaagaaagaaagaaaaagaaagaaaaagtaaaaaggtcacagtgaatgatgcatgaaacttcaacataactggtctaactaggtttagctggagtcttagaagtagaagaaagaaagaagtaacagaaaaaaatagtggttgaaatatttccaaatttgataaaaactataaa

SEQ ID NO: 206622 - DNA, 601 bp, Human
accacctcccgcaacgtgccttctctgttctgtcactactgaagaaaactgtatcactggacagacgagtatcatgggccaaaatccatggtttccaacttcacatgcacttgcaggtttcttgtttatccttttacttgtctctggtcagcttcctctcccatgctgctgaattactgttctaacatataccactttccccaaccctctctgttgacctgtcatcccctcattcttggacatttaggacagttccacttttttgttatcataaacaaggctaaggtgaacattcttgtayatccttcttttttttttcacttgattgtgattttttttcttaaacaacaagcttcttgaaaaagttagtcctacctgttgctgccattttctttaccgtctattcaccaatcaatctattattatctggcttctgcccctccactttgttgaagttcctctcatcaaggtcaacaatggcttccatgttgccaaatctaatgaataagtccttagcttattggaactcttaggtgcatctgacacatctcagcattctctccatcttttaaacttttgacatctggttttctttccataa

SEQ ID NO: 206623 - DNA, 601 bp, Human
ctctgctcttctgacctcgtgtagacacccaatcccctgatccctgccttctccctgtttgtctgctgtcttttggcctcacaaccagcctagaccacatgattacacacttgaaccctctttctccatcaccttcatcaccttttgccccacctacctggaaaaatcaccactccaagtcaacaccacctcccgcaacgtgccttctctgttctgtcactactgaagaaaactgtatcactggacagacgagtatcatgggccaaaatccatggtttccaacttcacatgcacttgcagstttcttgtttatccttttacttgtctctggtcagcttcctctcccatgctgctgaattactgttctaacatataccactttccccaaccctctctgttgacctgtcatcccctcattcttggacatttaggacagttccacttttttgttatcataaacaaggctaaggtgaacattcttgtacatccttcttttttttttcacttgattgtgattttttttcttaaacaacaagcttcttgaaaaagttagtcctacctgttgctgccattttctttaccgtctattcaccaatcaatc

SEQ ID NO: 206624 - DNA, 601 bp, Human
gtaccaccactggttttttacaaggttatatttttcccctaattttcaaagtaaggtatttaaccacattcatttaagacagctctctctttccagtctgacttttccatcagacttctcccttgttttgagtgtaactggaatggcgaagaggaagttgaggtgaggatacatttagtttgggtttagagagatacatttatgtggcttgcaatcacttattgtgtatagttaacttactgctaatggtgtaggaatggcttcaggaatggtcctataacctaaggtgtttactcatccrgcatccttacacaaaaaggacagagccagaggtagcatcatgatataaatgtgtcctatagcatctggggttagatacattggatagtagaggagaaacaaaatttgaaatgtacagagttcaaagtttgtgtaaaattcttccaatgagcatattaaaattttaagtggaggatttggtttttaacaatgcctagtcaaaataaaattttctcctttaaaaaacagagtcaatagtgtagcatatatgagtatatacaaactgtattttttcttttttcataaaagttgtgcaaaatgg

SEQ ID NO: 206625 - DNA, 601 bp, Human
tatgccaggtatgttccagagacagcaagaagggcctatgtggttgggagagaatagtaggaaatgaggttagaaaagtgataggagccagatcatgtagggtgttgtaggccactgcaaggacttaagcctggtattgaggaggacccctgatttttagggcagacaagagtacaattagcataacactcagaatatagggaaagaaatataggtattagagaatggatgaatttctacatgctgagtggtgagctgacttccttctgagaaccacactttcacattcatttgcttttgracttttctacgtgtatattcgtgactcaaactcaaattgctctaacagaaactaaagtattttctttcttcctcttctgttctctgtcccagttaatggtatcctaagtcagaaatcttgagaggcatctctctgctttctcttgctccatcatgtctaattagactcctaacactgacagttttactttatagatgtcttcttctctcttccctctgccttcacgttggttcaagctctcatctctcactggaccattttaatcacctctgcaatcctacaacctgtctaccaacttta

SEQ ID NO: 206626 - DNA, 601 bp, Human
attcaaaattcactcttctagctatttgaaaatatataagaaattgttgttaattatagtcaccctatagtgtatagctattttatttacttcaggcacactgaacctagcattgtgcttggctcaaggaagcactcaatgactatttgtggaatgataatttcacagtgtagctcagaggatgaaagacattacattctgtggcctggtatagtggccaccagaaaagtgtagctatagagattaggcctgaaagagccagtcacatagctgccaagatttggaactgaagaagtatatytttaatatgttttagagtcacaatgaaacaagattccctgatgggaattttcccaaagactggatccagacacccaataaaagggttacaagtgtacttgcatataatttgcaaatggtttatgtctaactgcattctctgtcatctattccctggtgattttcaaggcaaaaatttatcgttaccctaaaggttattgcataatttataaaaataataaaagtttatcttctcttccttaaaaaaacagaacaggcagtaccatattttgctgtcaaggctgttcagcacagacaactc

SEQ ID NO: 206627 - DNA, 601 bp, Human
gctcctctccctgcagaaggatgtgctatctcgtgcttaaggagtttagtagcaggaggaaagggaaagatggaggccagcagggcgggtttctgtagctctcttcctgctatagcctctggttttagtagagtaattccctcactccctgccgtcatcatcaaagcagctcccaggctccaagtaaataacagacaggaaaacagtggggtggcaagagaggttgtgtagggtagtggtgaagagctcagactccagagccaccctgcctgggtctgaatcctagccctgccacttactmattctgtcaacttgggcaagccatctatgaaatggggataataatagttgttgtgttgtgaggatacagataaataacgcatctaaagcacttaaaacagtgccaggcacatagtaatcactccatgagtgcttgttgtacttcttctttctgagtacctgcttgtttccagggactgtggtaggaattagggatgcaggggaggatcagacagtttttgcccttgaatttagtatagttgaggagacagatgagtaaatgaattacaatacaatataataaggtctcaagttaactatg

SEQ ID NO: 206628 - DNA, 601 bp, Human
aaccaggtctgaccttaaattattaaggccatgagatacattaatggaaactcgtttcctctttatctgcaaaaggatcctgggttccttcatgctctgtcacacctgcctgcctttccgttcaccattccctttgcagagaatgcccagccctcccttctcagcctagaccattcctactcagctttcaagacccagctcaaatgtaacctctttgaagtctttgctaactccccaaagtcagagttcctcattccctcccgtgtgtttccacaaggctttttttttttttttttgagayggagtctcactctgtcgccaggctggagtgcagtggcgcgatctcggctcactgcaacctctgactccctggctcaagcaattcttctgcctcagcctcccgagtagctgggattacaggcacgcaccaccacatgcagctaatttttgtatttttagtagagatggggtttcaccattttggccaggatggtctcgatctcctgaccttgtgatctgcctgcctcggcctcccaaagtgctgggattacaggcataagccaccacgcctggccatccataaggccttttacagccctct

SEQ ID NO: 206629 - DNA, 601 bp, Human
cctaagatttggtatgggcctggcacatagtaggcgctccatacatctttgctgagtgaatgaatgactctgacatgtggccagtcaggcctggtcattgtcagcagctggcattacttaacatgagagatgcatacaaaatgaagggcagccagagtagctgaaaaacaggcggctctagtgacatcatgaaaaaaacaaaccaaaactggggaaggctgagacaacgcttccactcacgctttaacaaatgactctcgtttctgagcagcccctttttgtctgctctcccattcacttyccaaaacccagtcattgaaatgattctaattattcatggtcagtggcatatacaggaaacacttagtttacaagcaattaaaatacactaaaatagatttatgtaggttgaacctgatcctgctggtaagaagggagtaaatgacatagatcttggaggggtatttgctctccaaggttgctttttgtcattctttatctaccttacactagtttggtgctaacatggcaagcatccagaggtgtttcttaaggcaagggtactgtgaacatagcggggagcctgttccacagttgtaga

SEQ ID NO: 206630 - DNA, 601 bp, Human
cccaacctttttggcatcaggaaccggttttgtggaagataatttttccacggaccagggaggtggggatggtttcaggatgaaactgtcccacctcagatcattaggcattagttagattttcataaggagtgcacaacctagatcccttgcacatgcagttcacaatagggttcacactcctatgagaatctaatgctgcccctgatctgacaggaggtggagctcagatggtaatgctcacttgcctgctgctcacctcttgctgtgtgtcccggttcctaacaggccaccagccccrtggccccaggggggttggggacccctgctgtatactgttttttttttttcttttttttcaggagtttgatacgggggtagggctggggtaggtgggtgttttaagatgggaggatattaagtatgtttatgggctgagggaaaagaatctataggatgggagtcaggggcagcataataggtatttcgagttagttatgtctgtatttctggcccattagacagagatccacaagggaagaatactgtttttttttttaaatctctatattatccacagctcctaacataaggcctggaa

SEQ ID NO: 206631 - DNA, 601 bp, Human
gggtacctagctgaggtataggaggagggaatgttctgcctccaggtgcgaagatgacactgctgattctctgtcagtgacacatcatgagctgcttgattagggctgagtgtttggaacaacacgtcctcacttatgtgtgcctattatgcacttaccctcactctcctactttagctccctctttgaccaagagcatatggttgcaagatggtcagctgggaccaggactggctgctatgtgacagaactcaattctactgggattaagcctgttgtcctggtttcattagcacctggytttaactaactgagcgacacggtaggcacagtcatacataacccattctttgctgaagcaggctggctgctggtaataatagcaaagtctgggttcctcaagttctccccacctttgccaatcagatgttattcccaggtcctgcttatttgcactgttcttaggttaggggactcagattgtttaagaaagtccttgtgttgtgagccagttctacatggcagctggctggcctgcaaaggtagaaacttctgtcatgttctgtttgcataccctgcagtgtccaactcaagtcatcac

SEQ ID NO: 206632 - DNA, 601 bp, Human
ctcactgcagcctcaacctccctggggttaagcaatcctcccacctcagcttccaatgtagctggtactacaggtatatacaaccacatccggctaatttttgtattttttttgtagagatggggtttcaccatgttgtccaggctggtcttgaactcctcggctcaagcaatccacctgcctcagtctcccaaagtgctggattacaagctcgagccatggcgcccggcccagaatttttaaaattttcagcatgacatttttgtaacttatttttctgtttaacaacagcaataacaaygatgacaagaagcctttccatctcttatactctttagtgaaacaagaaagagaggaacttgcttgatgaagaagcccaagctggcagtaggctcctggaaaggaccacagggagatgaagaggaataaagagccagcaggggacaggaaagagagataaaggatggacatcacagagattttcacctgaagtcatgcaaattggctcaggtatcctccaaaaccctactctgaagtccttccaagaagccctaaagcaaatggtcagtttatccttgggaccaaccctacctttcaactt

SEQ ID NO: 206633 - DNA, 601 bp, Human
aagagtttggccatattcacataccgcctatgtggacttttcttatatagacataaaaaaaccccagcctcatcctaagtaatatctttgaaaccaaagagtttgatctgataattatatttctttttaatacacattgaaacatatatctatattgaacatactaaatccatttctcttggggtctttgatattgcttgtctcttcatctagaatgtacttcactaccattttttttttttaagacagggtctcactctattgcccaagctggagtgcagtggtgcaatcatggctcackgcagccttgacctcctgggctcaattgatcctcacatctcagcctcccaagtagttgggactacaggtatatgtcatcacacccagctcagttttacattttttttggtagagacagggttttgccatgttgcccaggctggtctccaactcctgggctcaagtgatctgcctgtctcggcctctcaaaatgctgggattacaggcgtgagctaccatgcccggccgaactcaaattttgtaaatctccttccctcatttcattaatctctgttcccaaatgtcacctcctccgagaggt

SEQ ID NO: 206634 - DNA, 601 bp, Human
cttgatctcgtgatccacccgactcggcctcccaaagtgctgggattacaggtatgcccggccttgcctatctacttttattttaaattttattctgcagtaaaattgacatttgtgcatgtgcagatctgattttaaacatatgtatagattcatgacagagaggagttccataacccctcaaatctccttgtgctatccttttgcaatcacatcttcctttctcccccacacctagcaagcactgatctgttctccatcactgtagtgttgtctttttgagaatgccatataaatgcawtcaaacagtctgtaaccttttaagataggctattttatttttttactcagcataatgcctttgaggttcatgcagatttgtgcatgtatcaatagaagttcattccttttttgtactgagctcttacttttaaaataattatagaataacaggaagctgcaaaaaaaaaatagtgcagagaggttctacacacccttccccaggtttccccacatgttaacatcttacataattactgttcaatatccaagtcaggaaattgacattggtacaattcacagatcttattaatatgtcact

SEQ ID NO: 206635 - DNA, 601 bp, Human
cacccccaacttttcttccttcccttagcaaggcacaaccctcctagcattttctcttgtgagtacctgtgaaacacggattgggggctttcctctgatctcaggcctaagagtctttgagggaaaagtgatcatttgaaatcctaccggactgggctctaggaatgaaaagttgctcactttgtccctccgtagtctttgccttgccacacttccccaagtagaaacactgggctccaaaccctactggccacttctctgaaacagaaacaatgctccctgagggcagggcctggctgtyttacttttggttgatttccaaagtcttgcacagtgcctcactcatagtaggtgctcagtaaatggctgaatgaatggacgaatgaaaggaaggaaggaaagaagaaacaagtcagaaacaaactacttgcctatcttttttttttttttttttttttgagatggagttttgctcttgttgcccaggctgtcgtacaatggcgcggtctcggctcactgcaatctcccgggttcaagcaattctcctgcctcagcctcccgagtaactatgactacaggtgtgtgccaccatgcccagcta

SEQ ID NO: 206636 - DNA, 601 bp, Human; identical to SEQ ID NO: 31857

SEQ ID NO: 206637 - DNA, 601 bp, Human; identical to SEQ ID NO: 31858

SEQ ID NO: 206638 - DNA, 601 bp, Human; identical to SEQ ID NO: 31859

SEQ ID NO: 206639 - DNA, 601 bp, Human; identical to SEQ ID NO: 31860

SEQ ID NO: 206640 - DNA, 601 bp, Human; identical to SEQ ID NO: 31861

SEQ ID NO: 206641 - DNA, 601 bp, Human; identical to SEQ ID NO: 31862

SEQ ID NO: 206642 - DNA, 601 bp, Human
ccaggtagtgggcagtggataagtgaatgaagccaacgagttgaggaccgtgataaattcctggtatatagctagctccaaaggggcagctgattggcaccaattcagtatatttcaagagaactttggcataaacaaaatagatggatggatcaagttggcccacaggctgctagtttatgaacttgatgcctttctccatgggtactttacaaatgggacgtacattttgactagagtaactagacagggaccagagaaaggagatacacaggatatacacaatttgttacaaccttgrtaaataggctttcttatgtggatgtactgcacatcagtaaataaggagattatttgctatgttcaaaagtggaggctaaaacttgttgttacttcagaagctgtgcttttattttaaagcaggggttcctgagcctcagcactcttgccatttcaggccaggtaattttggtaggagctgtcttgtgcactgtgggaagttgagctacatccctggcctctacccactagatgccatgagcacctcccactccaagtcgtgacaaccaaacatgtctccagtcattgccaaatgtcccct

SEQ ID NO: 206643 - DNA, 601 bp, Human
tggtgaaacctcgtctctactaaaaatacaaacattagctgggcatagtggtgggtgcctgtaatcccagctactggggaggctgaggtaggagaattgcttgaacccaggaggcggaggttgcagtgagccaagatcatgcccttgtactccagcctgggtgacaagagtgaaacggcatctcaaaaaaaaaaaaaaaaaaaaaaagaagaaaagaaaaaaagaaaattatcctactcattgaggtttttaagtcagtttggatagctgagatagttgtcactgaacagtcttaattttycctgtgacatttgtccccccccttcttcttgagtaggttagttgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtgggggggctaggggagagatagcattaggagaaatacctaatgtag

SEQ ID NO: 206644 - DNA, 601 bp, Human
gcatagtggtgggtgcctgtaatcccagctactggggaggctgaggtaggagaattgcttgaacccaggaggcggaggttgcagtgagccaagatcatgcccttgtactccagcctgggtgacaagagtgaaacggcatctcaaaaaaaaaaaaaaaaaaaaaaagaagaaaagaaaaaaagaaaattatcctactcattgaggtttttaagtcagtttggatagctgagatagttgtcactgaacagtcttaattttccctgtgacatttgtccccccccttcttcttgagtaggttagytgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtgggggggctaggggagagatagcattaggagaaatacctaatgtagatgacaagttgatgggtgcagcaaaccaccatggcacgtgta

SEQ ID NO: 206645 - DNA, 601 bp, Human
ttggatagctgagatagttgtcactgaacagtcttaattttccctgtgacatttgtccccccccttcttcttgagtaggttagttgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtggggrggctaggggagagatagcattaggagaaatacctaatgtagatgacaagttgatgggtgcagcaaaccaccatggcacgtgtatacctatgtaacaaacctgcacgttctgcacatgtaccccagaacttaaagtataataaaaaaaattaaatgctttcttctttgtcttgtttatttcaatgtttaaggttagttattcctctgagcactgctttagcagctgatgtgtgtatttggtcttttttctcttagctcttctgtgtcttcaggtttttattttcctatgaatgaagagttg

SEQ ID NO: 206646 - DNA, 601 bp, Human
ttttggatcaatgtattgtttttgactggcagttaatgttatggtggctccttgttatatttgcacaaatttgagttctctttcccttaagcagttgtgataaattaaaaattctcttaattatataagaaaaggagaacttggactattatggcataaagatagaaccttctgaatgttgaatgagttggtaggaaatgattcacattttcttttggacttgcttttcatctttcagtctcgccctgtcggcttctggttcccatattaaccacttttctcccctccctgcagactgacstcccatttgtttgattttccagttacttttgcacagccacacttgcattaaagagattttgctcctgcctccttttcttagattttatcctcaattgtctctttccaaagggcaggcgctcacctcttttttgtaacctcttacagcttcctcagctcagcttgctctgcacagagcaggtgctccataaatggcaattactgatggcatgcctgactccatatcgaggttattaaacattatgccactttcatttagtcagttatataagtttattttatttatttatttatttattta

SEQ ID NO: 206647 - DNA, 601 bp, Human
tttgtgatagcccttcctgcttttgcccatatatttacatgtgttaacactgtatgttggtttcctttttatctagtgcacagtctgagttttcatatgctcagtgttacctatatcatttacggtgcttttatcatggtcagatttgtcacctatagcagagtttgtaagtagttattaaatctctctggaatctattgccattttctgatgagcctttgtagctaactcatttttaccctgttctgctgtcaagttgcccaacaattattaagacctcaagtttttctcttgaaacttsgctgtttctcttttatcttggccgtttctctttgatcatatgctaagctctcagagtagtttgtatttgtggattctagtcaacatggcaacttttctgattttaactaaatatcacattttaactttgtaatttatgttgaaatttggtgagggcagttccttatttattactttacattttaaataattcttgcttttcttgtgtactaattcttcttgataaattagtcattgtgcaccttgaatagcatatcatcaaaagtgtgctaagggaactgtggatgggttacgtggtgtt

SEQ ID NO: 206648 - DNA, 601 bp, Human
tctgtaatcccagctactcgggaggctgaaataggagaatctcttgaacctgggaggcggaggttgcagtgagctgggatcgtgcctctgcactccagcctgggcgacagagcaagactccatctcaaaaaagtaaaacaaaaaaataaataaataaatttcttgtaatggctgccagttcctatattggacagttctcaggtctagaacactctcagaaggcactgtagcagaggagggtgctgagcatagtgcagcagagcccggggtggggggataggggactcctacctcagcaacrcagcagaccagtagcgggcaggagtggcaggaaggctggctgggtgccaacaggagaatgaactaaaagtctgcagacagaagggccaccctctgttctgacctctagaacattaacagcaggcagttatccctatcggcaaggtaaaggacaaaagggggttcttctctaaagacactgatggaactatttcaggagaatcagggaagctggtgtggtattagcgcccactgaaaagccccagtgtaatcaggaattcagggagctctctccgccaagagccccacagggctcccagtc

SEQ ID NO: 206649 - DNA, 601 bp, Human
gcagaatcatcagatgagcccagggaatgggttctcagggctgaccaagcagtaactgacagttcgattgtgtatcccatggcctcagactattctgtttgagcatcatcagcgtcattagtgattgctatttaattagcccctcttctaagttttaagaatatgtgactgttaaatattgtggtttattaagtttttatttatagagatgggggtcttgccacattgcccaggctggtctcgaactcctggcctcacatgatcttcccatctcagcctcccaagtagctaggattacggkcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtcatcgaacttcagcacctgacctttgtcatcaacgccccgcaggaccataagcttttctctgaatcctgaactcaaaaaactctgaaaattgaatttctttttcatatatttgctgccac

SEQ ID NO: 206650 - DNA, 601 bp, Human
tggtttattaagtttttatttatagagatgggggtcttgccacattgcccaggctggtctcgaactcctggcctcacatgatcttcccatctcagcctcccaagtagctaggattacgggcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtmatcgaacttcagcacctgacctttgtcatcaacgccccgcaggaccataagcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctg

SEQ ID NO: 206651 - DNA, 601 bp, Human
aggctggtctcgaactcctggcctcacatgatcttcccatctcagcctcccaagtagctaggattacgggcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtcatcgaacttcagcacctgacctttgtcatcaacgccccgcaggaccatargcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctgaaaccatctagatctgcaacttctagagaagagatgagaagctgactatg

SEQ ID NO: 206652 - DNA, 601 bp, Human
taactcttctttttcttttttttttttccttttaggtatatgcagagttttcttgaacttttagaatatgaaaataagagccctgaggatccacaggtcttggataagtaagtatggtaccacttagctgaaagtaaaaatatctaggtaagaaagattttggtaaatgtaattcaagtcattaagactcaaggagtatgaatgtggacaaaagcgttcattttcttaatgagtagtgactcaacattgagttttttttttttaattcgagctaagaatgtaacacaatacaaaagtaatratgacactttcagttttgcttttatgatctaatacttaatacctttacccaaggtgaactgggcagtcactataaacactgcagtaaatgttccatctagtggtagttttaagaatgcagtggcctttttatatacatgaatttatctactcaatcctttacaattaaaaaaaaaatttcaataggatattacatttgagctcaaaaactgtagtggttttattttggagaggcataaaagtatgtttttttatatagcaacctgaattctattgctccctttatgcacagactggcaaa

SEQ ID NO: 206653 - DNA, 601 bp, Human
ccctttcacattaatttcttcctgtttcatgtatatgtaagtggatgcatatggtaggcctgttgtgctgagaaatttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacrtctgagccatgagtagctagttctagtctagttgtaaactaaaattcaaaggaaaaacaaaagccctcacctattatatactttgttgggtgtttgtctgatggatctgtgaagtgtggaaggcagggaagcattgggttagagccccagatgtagcgttttccttgatataagccactgctgtcatttaagcgattattaaatgaattcaatccaggagctttgttttctcaaaagtcattagctggtaaccgtttggcagaaatcctaaaacctagggctgaccactgtagctccaaa

SEQ ID NO: 206654 - DNA, 601 bp, Human
ttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacgtctgagccatgagtagctagttctagtctagttgtaaactaaaattcaaaggaaaaacaaaagccctcacctattwtatactttgttgggtgtttgtctgatggatctgtgaagtgtggaaggcagggaagcattgggttagagccccagatgtagcgttttccttgatataagccactgctgtcatttaagcgattattaaatgaattcaatccaggagctttgttttctcaaaagtcattagctggtaaccgtttggcagaaatcctaaaacctagggctgaccactgtagctccaaattttagaacaaatttgtagaagtatagttggtcctttgtactggcagtttccacatccttggattcaaccagccac

SEQ ID NO: 206655 - DNA, 601 bp, Human
aaaagatattcaggaaaaaaaaaagcaataaaaaataacaatgcaacaataagaaataatacaaaattttaaaatacagtctatcaactgtttacatagcatttacattgtatcaggtattataactagtctagagatgatttaaagtatccgagaggatgtgagtaggctgtatgcactattttagataagggacttgagcatctgaggatttgggtatctgcggggatcctggaaccagtcccctgcggatactgagagacgactatacacgatgttaaatttctgctgtgtttttccyggagtcccgtctcagtttctggaacaggttatccgatgtgatttatggccacgagcctgctttgcaaactgtcagtgctgaatccagtgtgtgcttgacgatagcaataatagctgagctctcactccgtgagttttgtagcttgcctaggttcatgtggttagttatgatagttggcatttgagaaggctgatgttcttggtgaaggaaggagtgaaaggtgagcgagtatcatggtagcagccttttctgtttaccaagaggttgtatgggatcaccagcagggaaatcattttagta

SEQ ID NO: 206656 - DNA, 601 bp, Human
atttacattgtatcaggtattataactagtctagagatgatttaaagtatccgagaggatgtgagtaggctgtatgcactattttagataagggacttgagcatctgaggatttgggtatctgcggggatcctggaaccagtcccctgcggatactgagagacgactatacacgatgttaaatttctgctgtgtttttcccggagtcccgtctcagtttctggaacaggttatccgatgtgatttatggccacgagcctgctttgcaaactgtcagtgctgaatccagtgtgtgcttgacsatagcaataatagctgagctctcactccgtgagttttgtagcttgcctaggttcatgtggttagttatgatagttggcatttgagaaggctgatgttcttggtgaaggaaggagtgaaaggtgagcgagtatcatggtagcagccttttctgtttaccaagaggttgtatgggatcaccagcagggaaatcattttagtaaagcaaaagtagcttagaggacaagcttgttgatcatttatgatagagtttagaagagcccggaagattggaggagaattctgagcattgagccattgag

SEQ ID NO: 206657 - DNA, 601 bp, Human
agtaatatttaacttacaaatacattgcaacgagtattacataaaggacaaattgtctattataaaattttttgtgaatgacgatggcctaatttcagagttttacatctttattgtcattgtacgtatgtatttgttacagaaatatttcgtcaaatatttcatcaaatatttcagaaaaataagactattgagataagtaaaaagaaagtcaccccaaatttctactaccaggggacaaccactattactattttcctttcttccgtgcttttccctaggcatgcatatatttatatgygtaaaatatttttacaaacataacaagtgtcaacattatagatctacaccattattaatagtttcataatattcatgttaatagtccatcttcagatagttcatgcaatttgatcttctatcactggattttagactggtttgtagttttcatgctactataaacaatgctttaaagaacagcttttaaatacatctgttggccgggcatggtggccgacgcctgtaatcccagcactttgggaggccaaggcgggcggatcacctgaggccaggagttcgagaccagcctgggcaacat

SEQ ID NO: 206658 - DNA, 601 bp, Human
tagtcgcaatttttgcttgatttaaaaataagaacacctataaatatttggatgcagattgcttttttctttggggcttcttttggcttttattcagaaacaaaattttgcaaatcttgtatattgtgaaattatctgagtgtatttttaaaaatacttgaacaagtattgtttgtgtacacaacattgaaacataatctccatgggggaggcatctgaaatgctgccagcgaagacactttgcaagcttgtccaaatggtatagaccacatgttctaaatatttaatgaaagttggagtwtgtgtctggagtagtactaagaaggtgggtatacttgactaaggatgaaagtaagtttcttcatccatgtcacattgggagaggaagaacggattgggcacctggcacgtgtcactgctttagaacctgctgactgcaactgacagaccttaaaccacatcctcctccttcattgaccaataagagttgttcacccatcaattgtgtgtattccattgctctaagttgctgtggatgctaaaatgatttttacacataagatatcctttctaaacataagcccctatatttccctgtgtg

SEQ ID NO: 206659 - DNA, 601 bp, Human
ctccaggttttaatgacagccctactaatgattttcttagctgtgagaatcctacatggtttaagcatagtcagatgtccagcccaaatgaccctgtgtgggcgtctgtgtgtgagcctctttgtgtgcacacatgtgtgttttataggtttaataagtgttggctaggtgcagtgacacacacctgtaatcccaacactttgggaggccaaggcgggtggatcacctgaggtcaggagttcgagaccagcctggccaacatggtgaaaccccatctctactaaaaatacaaaagttagaygggcatggtggcaggcacctgtaatcccagctactcaggaggctgaggcaggagaatcgcttgaacccaggagacggaggttgcagtgagctgagattgcgccattacactccagcctgggcaacaagagtgaagctccatctcaaaaaaaaaaaaaaaaccacacaaacaacaacaacaaaacaagtgttaagcccactcccatccttagatctcttgagacagattacagaaaactcccatgtagaagagtagagacaatatttttatttttgactagacagttgtatcaacatataa

SEQ ID NO: 206660 - DNA, 601 bp, Human
cctgtaatcccagctactcaggaggctgaggcaggagaatcgcttgaacccaggagacggaggttgcagtgagctgagattgcgccattacactccagcctgggcaacaagagtgaagctccatctcaaaaaaaaaaaaaaaaccacacaaacaacaacaacaaaacaagtgttaagcccactcccatccttagatctcttgagacagattacagaaaactcccatgtagaagagtagagacaatatttttatttttgactagacagttgtatcaacatataaaagtggggtgcatcttgygtagcattaattgaatgtgcagaacactgaaacatgcctccttgctgcttatttagcaccttagtatctacctttacacatctacaaattatagaccccaggtagtgaatgctagaattagtgttgtaaagcaggtcctattatcctttgggaggtgccttccactgtgacccttttccctcctttctttgtaagaagctaggaaataaaatggaaaatcctgctgtaagatcattttgaaagtataaacttaaatacttggtgtaaaaatcgattctcacagcgatgctaagttgcctg

SEQ ID NO: 206661 - DNA, 601 bp, Human
aggaagcactttatagttggagctatagaaattggaattatcagcctggccaacatggtgaaaccccatctctgctaaaaatgcaaaaatcagccaggtgtgatggcgtgtgcctgtgatcccagcaactcgggaggctgagacaggagaatcgcttcaacatgggaggcagaggctgcagtgagctgagattgcaccactgcactccagccttggtgacagagtgagactccatcagaaaaaaaaaagaaattggaattaggaaacagaaaacaaggttgttttctgtgtgtctttgcarctggagttgccaagtcatggcctttccgcctttctctgtgcctgctcctttacctgtttttgtctgtgtactggacgactcagtggcagcttgttgggcactctagtccttcacagatcatgataattttcaatgtaccattttggcttctgccctgcctgatcaccccaactgtcttgatcctaaattctcaaaagatgcatttaattaactcagcttatctttttttgcccacgatcttgattctgaattcccaaaagatgaatttaattaactcagcttatctttttttttctttcc

SEQ ID NO: 206662 - DNA, 601 bp, Human
gattggtgggacagagcagaagcagccacaggggaggaggctgcagcagaggtggcaactggtttgccgaagattgtcctggagggactctgggggcagggccaggtggtgcaatggactggaatgggaagggaaggcagagggtagggttaactgaaagctggtctaagaaagagcatggagggatgacgggaggcagctgtactctggccgggttcagcctgccaacaggcaactaagtattttgttcgagaacaacctaggaagaattagggcttttcatgtgagtgttgttaccctrcagcaaagccctgttcgtttaagcatttgggggcctctctgctcagaggcccatttactacctgctcatcctcaagccaagttgaaaagtcttgaccagtccagagagctctaagtcaggcttcccacttaatggagagccccagggggatatgaacgccagctccctcatacagtgaatccggttcttcattctcaaacaagaatattgcaaccaagatggatcagaccttcagcaaaagccagcagcaagaaccaaacctaactggcattaaacttatcagctctactgttactgcca

SEQ ID NO: 206663 - DNA, 601 bp, Human
ggcaactggtttgccgaagattgtcctggagggactctgggggcagggccaggtggtgcaatggactggaatgggaagggaaggcagagggtagggttaactgaaagctggtctaagaaagagcatggagggatgacgggaggcagctgtactctggccgggttcagcctgccaacaggcaactaagtattttgttcgagaacaacctaggaagaattagggcttttcatgtgagtgttgttaccctgcagcaaagccctgttcgtttaagcatttgggggcctctctgctcagaggcccrtttactacctgctcatcctcaagccaagttgaaaagtcttgaccagtccagagagctctaagtcaggcttcccacttaatggagagccccagggggatatgaacgccagctccctcatacagtgaatccggttcttcattctcaaacaagaatattgcaaccaagatggatcagaccttcagcaaaagccagcagcaagaaccaaacctaactggcattaaacttatcagctctactgttactgccagaaaccccccttttgaaattctgagagaaaatcatttcaaacctagaattctc

SEQ ID NO: 206664 - DNA, 601 bp, Human
tgtgatcttggctcattgcaacctctgcctcccgggttcaagtaattctcctgcctcagcctcccgagtagctgggactacaggaccctgccaccatgcctggttaatttttgtatttttagtagagacagggtttcatgttggccaggctggtctcgaactcctgacctcaagtgatctgcctgccttgacctcccaaagtgctgggattacaggcatgaaccaccgtgccctgcctgtttcctagaattttatgatggaaacctttaggtggcatagatacccattttcagtttttccrtttttctagactgtaacaggtcgtgagcagcggtgctccatgaaagggctggagggaatgagagtctcatgtttattataaagggctatggtttagaaaagttcgagaaacagtgcattgcatgaggctgactagaagcaagttgagaaggcgggctgtggttgttgaggtgttaagggtaaacataaacttagaagaaccaggtgcttttatattttgacagctgggaaagacatagaagaactattaagaagatagaattgttttgctgcgcagtacagcaacagtggatgttcaaga

SEQ ID NO: 206665 - DNA, 601 bp, Human
gggttagtttgtcattttctgtgaaaactgttggatttttatatttgcctcaaatttatagaataaatacatagattcatgtagataaatgctaatagagctgggatttgaattctgggtatgtgctactacttttcataaagctcttgcacaacttttgttagatatttttgttagatactgtgtaatttttgttgtcattgtgaataggattttcttttagttatagttgctattattgctgatgtataaggatcactgttgacttatatgtattgatcacgtaaccttgctgaactckcatcatatttcatagattctgaggtacacttttcccccctacatcttcacatatctgaagtcaaaatagatctttgatggtgtcccataatcactgttgtctaggcagcagtcatgatgtagttatcattgcttgcacatgcacaaacttggtcagggctcttcattttgtcatcactttaaatgagtatgtgcattgctgtattgttatttcatgccaaacaataaaactggaggcggaagaaattgcaaagtgggtgtctgccttgaaagaaaatcccataaataataatggatcatt

SEQ ID NO: 206666 - DNA, 601 bp, Human
tgattatgtacatgtatacaatgtgtaatggtcaaatcagggtaattagcatatctgtcacaccagcatttatcatttctctgtgttgggaacgttcagaatcctttcttctagatatttgaaaatacataatgaattatttttaactataatcaccctacagtgctatagaacactagaacttattccccctatttagctataatttgtatctgttaaccaaactgtccctatctctggatactatgatttttgacatgaattggtttttattatttagttctaaatatattgtgatctycataattttcctgttgcccattaaaattatttagaactttgtatttacaggattttctttttgtattactgttatctctgtgatatttatttctaattttattgtattatacttggggaacattgagatgcaaaaatcaactctgtttctctataccagcagcaaacaatttgaaaatcaaatttgaaaactaatataatttataataaggtcaaaaaacatctgataccttgaaataaatccaacaaagcataccaagaccttcagtaaaaaccttactaagagaaatgaaagaagacc

SEQ ID NO: 206667 - DNA, 601 bp, Human
tcctttcttctagatatttgaaaatacataatgaattatttttaactataatcaccctacagtgctatagaacactagaacttattccccctatttagctataatttgtatctgttaaccaaactgtccctatctctggatactatgatttttgacatgaattggtttttattatttagttctaaatatattgtgatctccataattttcctgttgcccattaaaattatttagaactttgtatttacaggattttctttttgtattactgttatctctgtgatatttatttctaattttrttgtattatacttggggaacattgagatgcaaaaatcaactctgtttctctataccagcagcaaacaatttgaaaatcaaatttgaaaactaatataatttataataaggtcaaaaaacatctgataccttgaaataaatccaacaaagcataccaagaccttcagtaaaaaccttactaagagaaatgaaagaagacctaaattaatggcaagagataaccatgttcattggattggaagtgtcagtattgtaaagatgtccgttctctctaaattgatacatacagaaattcagtgca

SEQ ID NO: 206668 - DNA, 601 bp, Human
tattactgttatctctgtgatatttatttctaattttattgtattatacttggggaacattgagatgcaaaaatcaactctgtttctctataccagcagcaaacaatttgaaaatcaaatttgaaaactaatataatttataataaggtcaaaaaacatctgataccttgaaataaatccaacaaagcataccaagaccttcagtaaaaaccttactaagagaaatgaaagaagacctaaattaatggcaagagataaccatgttcattggattggaagtgtcagtattgtaaagatgtcmgttctctctaaattgatacatacagaaattcagtgcaatcgcaataaatatctcaatagggctgttgctgctgccactgctgcttttttttcttttggataggctagttctcaaatttacatggaaaggcacagggccaagaatggcaaaggcaatcttgagaaaaagttggaagacttaacactaacatatatcaacacttattataaagctacagtgattaaattagtgggcgcaaagccagattgaccagtggcacaggatagagtccaaaagttgacctacacatacaaggtcagt

SEQ ID NO: 206669 - DNA, 601 bp, Human
ggcgtggtggcacatgcctgtagtcccagctacttggaaggctgaggcaggagaatcgcttgaacctgggaggcagaggttgtggtgagctgagatcgtgccattgcactccagcctgggcaacaagagtgaaactctgtctcaaaaaacaaaaaaatcccacacagtagagtttttaattactcttatcagtgggattttttcattcttaggtgtttacatgagaaagcttttgtcttcaagtatattaattttgtaccagcacaccttatgaattcataccgataatagtttttcagtygattctcttgtatttcctagatatagcatatgcaaataagtttaatttccttcaagtaataattatatcttctatttcatcatcttacctaattacactggctggcatttgtcacacaatcctataataatagtattaatggccattcttaattttgactttagagagaatacttctaatgttttaccttaggtttaatagatgtctttttgttataaagtgataactgacatcattctcatatcccaaaacacatgttctgacatgaactggtttaagattgcatatacttgagtattt

SEQ ID NO: 206670 - DNA, 601 bp, Human
gcaaaaactaataagctattttaaagtttttcactatgaaataaaagagtgatccaaagagttgagttgttttactcattccattatgatatatggtagaatgttatggaatgaacatggatattgctaaattattgaatgcattaaatggcagtactttattaaggaggctgtactgctttaaatatctgaaaactagttagaatgtgtgcatttcctcacatcaagctaagccttaaaaacaaaagcatttaaaactagtgtttgtagctcattggtacaagtaggttcagagagtattgtgtcaactcttaatctgagcaggaatagaagctttgagaaaataggctttaagaaggtttgtcattttacagccaagttttaatagattgtgaaagtttggactcttagattttaaacaaacaaaaccttgaaattactgattggctcagcgtggttttatggaaaaactaatacaaaaacttggccttgactatttgagcaaagcctacaaaagttccagatgggacagggcaaggaaggatggggctctatttacaacagcagatattttcttttcctcttcttgacgtggagtagg

SEQ ID NO: 206671 - DNA, 601 bp, Human
tagtacttgttcacccaaattctgagattcttggttctctgaaccatcctacttatttgtctttaggttcaactgatctctgggcttggtttgtactacaaaggcatggacaccgccagttacattatcacgtaccttcttccacccttcgtttatcatatctgagaactcctctgagtaggttctgttctgagaacagtttcattctgattgtcaaagggagttagtattctaactccagaggggttacaaagttgaggtatagtcatctctgtttagaatgtttgaatttttgtaatgrcaaaaccgaagggaaaatgaccaggcaaaacaatagtttgttgaataattactgctcacttaagatgagatgagcgggcacccccatgtaggccagaatatctattaggaaatgcacgtgatgtaaaaggatgggaagaaagcaaatcagtctgttaatggtagcttgggttaatactgcagagcctttgagtattgaggaactgctgaagtgttcagagcagggaagtagtatgatcaaagcagtgcttcaggagggttaatttgcctacagattgcagaaatgcctcaatacttggca

SEQ ID NO: 206672 - DNA, 601 bp, Human
ttatatcacaccaggtagctaccccttattataaataaaatgctaataagttttccattggactgtaaatgatcagattgtagtatattaaagaaatagcaatcaactttatcaggaaattaaatgtcagtgattttaaattaaaattttttttttttttttgagacggagtcttactctgtcaccaggctggagtgcagtggcatgatctcggctcactgcaacctctgtctcccgagttcaagtgattctcctacctcagcctcccgagtagctgggactacaggtgtgcaccaccacrcccagctaatttttttgtatttttagtagaacggggtttcaccatgttggctaggatggtctcgatctcttgacctcgtgattcgcctgcctcggcctcccaaagtgctgggattacaggggtgagccaccgcacctggccctaaaattttctttttattattattttatttttcttttagcggcagggtctcaccctgttgcctgggctagagtacggtggcatgattatagctcattgtaacttcagactcctgtgctcaagggatcctcctacctcagccttctgagtaccttggac

SEQ ID NO: 206673 - DNA, 601 bp, Human
atttatcctttgatccttgtatgtcctagattcagaggatgatttctaaatttctatagccatagatggagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggtaaaacacatataatgaaggaaaatagtatgtttgtcacctgaagttgcattacttaattttttttttttttaagagacttagagacrgagtcttgctctgtcacccaggctggagtgcagtggcacgatctcggctcactgcaagctctgcctcacgggttcacgccattctcctgcctcagcctcccgagtagctgggactacaggtgcccgccaccacacccggataatttttgtatttttagtagagacagggtttcaccgtgttagccaggatggtctcaatctcctgagcttgtgatccacctgccttggcctcccaaagtgctgggattacaggcgtgagccactgcgcccggcctacttaattaatttttgtaatcttcc

SEQ ID NO: 206674 - DNA, 601 bp, Human
gagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggtaaaacacatataatgaaggaaaatagtatgtttgtcacctgaagttgcattacttaattttttttttttttaagagacttagagacagagtcttgctctgtcacccaggctggagtgcagtggcacgatctcggctcactgcaagctctgcctcmcgggttcacgccattctcctgcctcagcctcccgagtagctgggactacaggtgcccgccaccacacccggataatttttgtatttttagtagagacagggtttcaccgtgttagccaggatggtctcaatctcctgagcttgtgatccacctgccttggcctcccaaagtgctgggattacaggcgtgagccactgcgcccggcctacttaattaatttttgtaatcttcccttaagtacctatgtgtatggttttcttttcttttctttttttttttttttgagacggagtctcactc

SEQ ID NO: 206675 - DNA, 601 bp, Human
ggaaaaaaaatagaagtaaaagaaacacatgggagagatggaaagaagaacaaatatgagttgaggagagggaggtggagcaaaaaggtaaaacacatataatgaaggaaaatagtatgtttgtcacctgaagttgcattacttaattttttttttttttaagagacttagagacagagtcttgctctgtcacccaggctggagtgcagtggcacgatctcggctcactgcaagctctgcctcacgggttcacgccattctcctgcctcagcctcccgagtagctgggactacaggtgccygccaccacacccggataatttttgtatttttagtagagacagggtttcaccgtgttagccaggatggtctcaatctcctgagcttgtgatccacctgccttggcctcccaaagtgctgggattacaggcgtgagccactgcgcccggcctacttaattaatttttgtaatcttcccttaagtacctatgtgtatggttttcttttcttttctttttttttttttttgagacggagtctcactctgtcgcccaggctggagtgcagtggcgtgatctcggctcactgcaagctctgcctcc

SEQ ID NO: 206676 - DNA, 601 bp, Human
ataatatcatggttgtgtatatagacacagatgttcattgtcacagtatatagctacctttgaggtcaggatgactgccttcttcagtctttgcaatctagattttatgattggcttctaagttaattatatgtttcttgaggacaggaactatttactgcatctttgctgcttatgtatcttccccatcacaccgtatgtatattaggtatgaaataaatatttgttgaataagtgaatatatgaatgttatagctgaaagtccgtgtacatcatgcctcatccaaggcattaacgatamatttcttccctaccagtagctattgtctcttgataaaaataggtaatagtaaatcttcaataaatgatatctatgtgccggaattgaaaatatagttagtttttgagatgagatctcaccgtgttgcccaggcatacatacatacatacatgcctgtagatgtgcagtggctatctgcaggtctgatcatagtgcactgcagcctcgaataatagcttctccaaggtcactcccagcagcattagggtgaggctttgaaaccagttatgttttattccaaagtgtccactcttaattctc

SEQ ID NO: 206677 - DNA, 601 bp, Human
agttgctcagatatccttttaggaggaaatacccatctttgatatcttcattggatttttttttttttccgagatggagtcttgttctgtccccccaggctggagtgcagtggtgcgatcttgactcactgcaacctccatctcctgggtacaagcgattctccttcctcagcctcccgagtagctgggattacaggtgtgcgctaccacacccagctaatttttgtatttttagtagagatgggggtttgccatgttggccaggctggtctcaaactcccgatctcaggtgatccacccrtcttggcctcccaaagtgttgggattacaggtgtgagccaccaagcccggccttcattgagtattaaatagccatccacacagggaccctgaggatgttgaataatatcaagtctatcctacagtttttcttttgattggattttggggttagaggtttaaaaaacattctggtaattaggtagtaagactattagacttgccatagtaagttagaataggctcattgttcacagaacctaattttatcttagcaatagtgaggtgtatggtaaggaaaggcctggtttccctcattgac

SEQ ID NO: 206678 - DNA, 601 bp, Human
tcactatattacccaggctgaagcaatcctcccaccttggcctcccaaagtggtgtgattataggcgtgagccactgcacctggctttgttttttttttttttttttagagggttaagaactaatatcttaatgaccaaacatttacttgaagattagcattcatatatttaacgaatgaatgttgcttgcttactctatatgctgggcagtattgtaggcacttggaatacattagtgaacaaaacacagggaagtttctttcccttatagacattacattctagcagaggtacacagayataggtgagtaatacagcatattataaggtgatacgtacttagggaggtaaaaagcagtataaggaggatttgggttataagtatggtcagggttttgctgagaaggtaacatttgagcagagacttatttttgagacatctgatagacaccaaagaggaaatacatgtacaaatctgagttatggagacaggtctagagtggagatgtaaatttgggagttgttggtacatagatgaaatttaagccatcagacagaaagagataaccaaaggagtgattgtagacaaactaagactaa

SEQ ID NO: 206679 - DNA, 601 bp, Human
gcagcaggataagtactttagttcatatgacattcctattcttgtatgatgatttgcgtattaaaaattttatgggtatatttaaactttgctgtaagttaacgtaagttatgttttttggaataaacagtggaaatttttgtcaccaaagtttatttttatgaataattttccaccagtttatttacttatttttttttgaggcagaatcttgctctcttgcccaggctggagtgcagtggcgtgatctcaactcacactgcaacctctgccccctgggtacaggtggttctcctgcctyaaccttccaagcggctaggattacagatgtgtgccactgtgccccactaattttcatatttttagtagaggcgggttttcagcatgttatgttggtcagggtggtctcgaattcctgagttcaggtgatctgcctgcctcggcttccgaaagtgctgggattacaggcgtgagccaccgtgcccagccaattttccaccaatttctaaattgctgtaggtttaatcactaattgataaaagttacatattcattaattttattaaactagagggagtgaaggcggtacagtcttcatgaa

SEQ ID NO: 206680 - DNA, 601 bp, Human
atgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttactamaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctgta

SEQ ID NO: 206681 - DNA, 601 bp, Human
ggatgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttacyacaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctg

SEQ ID NO: 206682 - DNA, 601 bp, Human
tctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagcttggtgctggggtgggyctccaagcttggtttgtgggtattggcctgaagtttggggccatgggggcctgcctagcattgagttttactggggcgagctcaatgttagggtctaagtctggtgtacacttcccctccttcccccaggtgaacagtctctctctccatgctgggatctcagggactgagggaggtgtgacacaagtaatgtaaaactgtccttcttacccttttcaatgtgtcttttcttatctgtgtgccacattcaggtaatctctcgtctggtttcttagctcttatatttttgtgtgtagacag

SEQ ID NO: 206683 - DNA, 601 bp, Human
gattttgttgaattgtttatctgcattttcttgaaattcattgagcttccttaaacaattactttgaattctttgtcaggcagttcatatatctccatttctttatggttggttcaggtgccttattgtgttcctttgactggtgtcacgtttccctgactgttcttgatccctgtagtcatgtgttggcacctgcacatttgaagaagctgagacttgttccagtctttgcagagtgactttattgggtaaagcccttcaccagtcagcctgtccagagattatgcagcctgagtctacmggggctggcctggagtctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagct

SEQ ID NO: 206684 - DNA, 601 bp, Human
tgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccactgtgttctttgcaccctgtccaaaatcaactgatagtacacgaatttatttctgtgctctccattctgttttgtgggtcgatgtgtctgtttttttgtttcttttgtttttaaaagacmgggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaatttttttttttttttaattttagagacagggtctcactatgttgcccaggctgctctcgaactcctggtttcaagtaatccttctgcctcagtctcccagagtgtgggaatacacgtgtgagcaactgtgcctggcctgtctacttctatgtg

SEQ ID NO: 206685 - DNA, 601 bp, Human
tttctttttgccatgcagaagctttttagtttgatgtgatctcattcatcaatttttatttttgttgcctgtgcttcgagggggtcatatccaaaaaaatcactgtccaaaccaatgtcatgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccrctgtgttctttgcaccctgtccaaaatcaactgatagtacacgaatttatttctgtgctctccattctgttttgtgggtcgatgtgtctgtttttttgtttcttttgtttttaaaagacagggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaatttttttttttttttaattttagagacagggtc

SEQ ID NO: 206686 - DNA, 601 bp, Human
actgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagccttagtgttagaggtaaagagtaaataccaaacataaaaaatctgatctggttgggtgcggtggctcaagcctgtaatcccagcgctctggaaggccraggcaggcagatcacgaggtcaggagttcaagaccagcctggccaatatggtgaaactctgtctctactaaaaatacaaaattagccaggcatggtggcacatgcctgtaatctcagctactcgggtggctgaggcaggagaattgcttcatcctgggaggcaggggttgcagtgagccaaattgcgccactgcactccagcctgggtgacagagcaagattccatctcaaaaaaaaaatctgaagttactgagaaactggtatgaaatcattaagaaaactaaggtgtctaaattaata

SEQ ID NO: 206687 - DNA, 601 bp, Human
ttccttacatttgaaacagaagatataggtttatatgatgcttcaggtggtagaaaagcagggcagactatgactcgtgtcacttccttccacacgtgatgcctttcatgggctcctgtgtctgtcagaagaaagcaaagggccttagcgtgctcctggctttctacatccaaatgcattttttcacaccttctcccatcagctaactctacattactgcaatacggaacttcttactactcagtggacttgttctgctgtcttctctgattccaggtgttattcttcctgcctagaacastatgattcttagctattcccaagcatcctcaaggtttcagcttatataccacttttaagataattaggtattcttcctctgtagtctcataccaaccagtacctattctattatatataataactgcctattaattaaatgggaagctgaggtatatgacctaataacttatttactgtcgtatcctcagaacctagcaaattacagagtctcaacagagatttttcaatttctcttctgatactgtctcgataacagtgtcaattaaacctttctctaattatttgaccttgaagggaa

SEQ ID NO: 206688 - DNA, 601 bp, Human
ctctaccccattgttttctttacctcttatataaactgataaaaacctgttttatcttaatcaattattgtatgactactgctccccagagaaaaaagtacatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtaaggtgttttcacygaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaagaaactgatagctcactgaaggcagacagaggaagacaaaaccagaaggcataagcttcaaaggagcagggatttttatgctgagagagt

SEQ ID NO: 206689 - DNA, 601 bp, Human
tgcacaacaatgtgcacagttaccacaattgtaccgtacacttcaaatcattaatatggtaaaatgtgttgtttttgacaatttttaaaactctaccccattgttttctttacctcttatataaactgataaaaacctgttttatcttaatcaattattgtatgactactgctccccagagaaaaaagtacatgtgaaatactactacttatccatctcctggctctgagcagtacatgtcaggaacaagagggaattgtagctggaagacagtagaagagccataggacaagtctctaasagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaa

SEQ ID NO: 206690 - DNA, 601 bp, Human
tggaaaaggcaaagttagagacacagtaaaaggatcggtgattgccaaggagtgggagggaaggaaagataaataggcagaacacagaggattttggggcagtgaaaacattctgtatgatataatggtagatacatgtcattgtactttgttcaaagccacagaacgtacagcactaagaatgatccctaatataaactacggactttgggtaattatgatgtatcaatataggttcatcagaaagacatgtaccactctggtgggagatgcacactggctatgagagaatctatacatktgtgtggaaggaggtacaggggaaatctctgtaccttcctctcaattctgtgaacctagaactcctgtaaaaaaaaaaaaaatctaaaaaaaaatagaatacatatgatccagtaatcctacacctgggtatacttccaaatatattaaaaacaggttctcaaaaaaatatttgtacacccatgtttatttcaacattacaatattcaagaagtggaaggaacctaaacatccatcaacaaatggttaaagaaaatgtggtatacatatataacaaaatgttattcagcctaaaagaaaa

SEQ ID NO: 206691 - DNA, 601 bp, Human
ctattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataaacccagctactcgggaggctgacgcaggagaatcacttgaacccaggtggcagaggttgcagggagccaagactgtgccactgtactgcaacctgggtgacagagcgaggctctgtctcaayagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgc

SEQ ID NO: 206692 - DNA, 601 bp, Human
caccatccttaatgatgagaaactagaaactttcttactaagatcaggaacaagaaaagaatatccccacctcaccactccatactggaagtcctagctaagacaagaaaaggaaataaagggtatactaacggggaacaaaaaaatacaactgcctttgtttgcagatgaaatgactatatgtgtagaacatagacaggaattgaaaaaaagaaaaagaaaaacaacaaaaacctcctagaactaataagtgattatagcaaagctgcaggatacaaggttcatataaaaaagttaatasctttcctgtaaaccagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaaga

SEQ ID NO: 206693 - DNA, 601 bp, Human
gaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaragagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatcttgattaaaaagcatatattaaagaaattaaatccataattaataatgttctaaaagagaaggcatcaggcccagatggattctctgatgaattctactaaacatttaaggaa

SEQ ID NO: 206694 - DNA, 601 bp, Human
gctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagarcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatctt

SEQ ID NO: 206695 - DNA, 601 bp, Human
tgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgwgccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaa

SEQ ID NO: 206696 - DNA, 601 bp, Human
caaaataatgtcaacaattgtgcttatgcatacaaatgctcctaaacttacttattgggttgtgtcccaataccattataaattgaaaatatcatgaaaacacaacttatccaaatttgtgggatacagtgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccrtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattga

SEQ ID NO: 206697 - DNA, 601 bp, Human
gagagcagagaacaggtgaacacatagcatcaccatttatctgagatgaaaaacacaagcagaaacctccacggggtaggaaatcctgaagtgtaatagacaaattgatgaaggctcagtgtggacaactctgaaagctaaaaactccagagttacccaattatagggggagccctacaattttctaagttttacatccaggcaattgaccagcttctcacagtaaatataggagaaaaatcctcaaccctcagcaggggaggcaaagagaaatgattttcaagtacactagactattccrgtcttaacaaggtttgtcctcaggagaaactagttaaccagagcctaacctgctggggttgtagcaaagccaaaatgatgtgggggaagagaaataacccaacttcaggccattatagctatcttgttctaactaagggaatgagggaggggtgggattgagaaacacttgtgaagttcacagtccagaggcataagctcactaaaaagactgacctaatcataagactacagaactcttctcctctccctacaccttacaaccacattactaaatgctcatttacaacagttcctttta

SEQ ID NO: 206698 - DNA, 601 bp, Human
atcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaaytgggcaagaaaaagaaatgaaaggtattaaatgagaaaagtaagaagtaaaattacttctgttagcaaatgacatgatcttttatgttgaaaactctagcctaccaaaaagaaaaaaaaccgttagaataaaggaattcagtaaagttacaggatataaaaaccaatattaagaaaagagttgcatttctaaatactaaaaatgaagaatccaaaaaggaaattaattttttaaacccatttaaaatgaaatcaaagagtaaaaaatacttagggaatattttcaccaagcaaatgaaag

SEQ ID NO: 206699 - DNA, 601 bp, Human
tcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcatggtggtgggcgcctgtaattccagctactcgggaggctgaggcaggacaatcacttgagaacccgggaggcggagctggcagtgaggtgagatagcrtcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaactgggcaagaaaaagaaatgaaaggtattaaatgagaaaagtaagaag

SEQ ID NO: 206700 - DNA, 601 bp, Human
aattctcaactggaatttattcataaaatccaaggatggttcaacatacaaaaaaatcactttaatacactgcattcttaggacaaaaaccaataatctcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcrtggtggtgggcgcctgtaattccagctactcgggaggctgaggcaggacaatcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacaca

SEQ ID NO: 206701 - DNA, 601 bp, Human
cttatataattagtctataaagctaggaaccactgcttagtaatttctcgtaagtggagtctctttgttctgagacgttgcaaaactccattccatctcaaagttatttttaatgttaaaatttgtaagagtgagcaacggtatcctaaatagttctaggccttgtagaaatagactgtaagagacatctgtgacacaactatattcagtatgatgtagggtctgttacaatgggatgaagtgaatttagattatttcaagactaaacctacaattgtgaactcattagtaccatgaaccraacaaaaacctattaaatatagaacaagacgattttcatgaaaaaataaatatgaacaaatcagtattttcagttgtttgaaatataggttaaccttcaattactgttttatggccgggtgcagtggctcacgccacgcctctaatcccagcactttgggaggccgaggcaggcggatcatgaggtcaggagatcgagaccatcctggctaacatggtgaaactacgtccctactaaaaatacaaaaaaaaattagctgggcgccgtggtgggcgcctatagtcccagctacttgggagg

SEQ ID NO: 206702 - DNA, 601 bp, Human
cagtgctacaaacagaagtcctatggaataagtcatacttggaagatcagagtttactctagacaacttgacagcaatcagtttaaaaatggtttcacctagagggatgtgtactaatgttagcaattaactttgaaaggcataaaaattaagatggattgatggatacaaggatggttatacgataaagcaatgtaagtattaatggcagaatctaggtggcaggcatatgtgtgtcagctgtaaaatttgtgttcaatgtttttttagttcccacatatcagtgagaacatgtgatatytgtctttccgtgtctggcttagttcactaaaaaaatgaatttacaagacaactggaatataagcaatgaatacaagcactaagaagatgaagccatagaaacagctgccagaaagtgaagatgtgacagtgaacgccaaacaagtaagattagaattacaattagaatcagaaatgacaaaaaagaaacatgaactgtgagatgcaatataaaaactaatggtgaacaaagcaaagaataaaaaataaaaacggaaagattaaaaggaaaatgtgactgtaagtagagtgacctttatat

SEQ ID NO: 206703 - DNA, 601 bp, Human
cagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatmcgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagcttacttgctataatttcttcacattccattgacttttcttattactcaaaaaacaaagtatgttataatgtgttgatttttaaaataaaacaaact

SEQ ID NO: 206704 - DNA, 601 bp, Human
tccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccawgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctc

SEQ ID NO: 206705 - DNA, 601 bp, Human
tcagtatttcatttttaacagcttgtaaacatttgacttatagttaacacagaatatctatctggaataaaaactatttttcccaattatcaacaacatgggagacttaaaaataaatttgtaagtggaatatccaaagatagtgttacactgaaagaaagcggctgcagcctgagtgaggcagatcatgactgtaatcaatcccataactgtgggaggctgaggcaggccgactacttgagcccaggaggtcaacaccagcctgggcaacatagtgaggctactctctacaaactttttwaaaaaaaattagccaagtgtggtggcatgcacctgtagtcccagctacttgggaggctgaggatcacttgagcctgagagtcaaggctgccataagctgaaattgcaccactgcactccagcctgggcaacagagctagactttgtctcaaaaacaaacaaacaaacaaaaaccaaaaagaaaaagaaaaagaggctccaaagtgtagaatcttaaatctaaaacttgtcactaaacctcctcattagttccacgtcacaagatggaatattttaagttccatcacgtgaaatcttatat

SEQ ID NO: 206706 - DNA, 601 bp, Human
agactatgtagtcatcaaaatctatttcctcttttcctgggcacagagttggaccacatttcccaactttttgagataagtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgygccaaatatacccttatacatgtagtgtacaacatgtagaatttttaatgactcccacctctgctataatatatgtttcacaatgaaagacaatataaaatgtaagtgatcattgaatggtctccaaaaattgaagcacaaaaataccaaattttatcatactaaggatctgatctgtggcccagctacaagagtaccaacacttacagtttcttttatgggccttaactctttaagaactaattctcaggtttgttctattaagaatatataagcatcttttgctaaacatcagtaacc

SEQ ID NO: 206707 - DNA, 601 bp, Human
aatcaaactggttcattttgggtcttcctagtttgttccagggtagtcattctgtgagtgattgagaagaatataccatttctcatcggctcttaagtagaaactgctttccacagccaggaatcaggttagactaaatctcatagagtgacagaaaatagtttttgagcaatgaaaacaaacagtgcaaagaagtaaacttatgagctggcaagcagtgcagagactatgtagtcatcaaaatctatttcctcttttcctgggcacagagttggaccacatttcccaactttttgagatragtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgcgccaaatatacccttatacatgtagtgtacaacatgtagaatttttaatgactcccacctctgctataatatatgtt

SEQ ID NO: 206708 - DNA, 601 bp, Human
ctatagtattattaactaccttaatttttgttgacattaaattttacttgaagatgataaaaaagtagcagcaatgacagggatagctaatactagaaatacaataaagctctgcgataatgcacctgagacaaatgtaaattttggtgaaatgtgactgacgactgctttctgtcttctggccactcttatattcttaaacagatacactaaaattatcttgtggaggaaagaaaaggaacaaatggcaaccccatctggaaaaccaggaagttaggatgagtacctgagtttccagtayttccctgctcaatctccctggacttgatgttacaggcaccactaatccccagatttttggaatagctgctgttttccagaagttccaagacccagagttgtctctatgaatttttaagtgggaagaaactaccacagccaggcagtgccgtccacacagggatattctaagtggcccagcaggactcaactcttactggcaacaggcactgatctgccatggtcacttcatcaagtccacaataatgcaactctgaattttacacgatggaattttttggacactacctataattttatg

SEQ ID NO: 206709 - DNA, 601 bp, Human
atcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctctg

SEQ ID NO: 206710 - DNA, 601 bp, Human
catcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaamcacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctct

SEQ ID NO: 206711 - DNA, 601 bp, Human
acagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacatacctttcataaaacatcactcacattcttataaaataccctatcattctgctaaactatgtaaagtaaggtgctggctgccttatgatcagtcattaagtgtattaattattcatgtgtctcaaaactatgtaagtgaaataaaaagkgtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacatttt

SEQ ID NO: 206712 - DNA, 601 bp, Human
tctgtaagcatcatctctttctattttcacagtttattaaactgcctaacacacatgatttctgaagtgaactgcttttgtgggctggcaatattcaagtacatatactatctagtgaatcctgatttatgataggccacactatattatctaattttgatataattaagcagaacttgctaaaaacaagttaccataattaaagagctcacagttaattttacactaacacctaaggctttaaaagcagttgtttccttaaaattctagaatagaatttaaaatatagaataaagtatayaccaagtacttaaacttttgtttttagtcttgctttactagagaaaaaaatgggggactgaggaaaataagactgagtagacttctgagcgaaagacagataaggaaggtagacaattttttgaaccctggaatgattcttacagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacataccttt

SEQ ID NO: 206713 - DNA, 601 bp, Human
ggtatttgtgaagagacaacttatattctattgattctaaaattcacttttttcacattatctctgaaatcagattacaccatacaaatgatagcatcttacaatgaattgctggtatttttctgtcttagcagtaataaaatgatagtgtttcctacaatcagagattagtgaaaatactatcaacatgaattcttctcttgtcatcaaagacaatttctctaaaaacctcaggaaaaaagctgctagtctggtttgaatttcacaatatataaaagcaatgaatatatttttctttttwaaaaaaatccacaattattaattcaagttaccactcctcaacagaaaacatacaagagtctcatatatgaagtcactattttctgggcttgatttctaaactaaggagtggataactctaaggtttcttttagctcttaaagcctaggatcccataattttatttatcaatattaagcttaccacaaagtttctcatttcttcttttccacccaaccctgctatacaattccaaaattagcaagtcataaaaaagtggccactagtttgttcactgtgatatataagaatgaggcttaaa

SEQ ID NO: 206714 - DNA, 601 bp, Human
ctgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaataaataaataaaaaatagtggggggtggtggcatgcrcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattgcataaacagctgtactgataattctttttcttaaaaataacctccatcaattgttcggtcaatttaaaaaa

SEQ ID NO: 206715 - DNA, 601 bp, Human
tacatttttcagagtcagaatgtgttcaaatataaatatgtaaaaagaataatttgaaaagtagttggtaactgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaataaataaataaaaaatagtggggggtggtggcatgcgcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattg

SEQ ID NO: 206716 - DNA, 601 bp, Human
ctattctatgctccccaccttggtgccaaaagaatgtaatgcaatgcaatatgttctattgtaaatgcaaacatacaactttacctctcttatttcatctgtaaaataaccataataatatagtaataaattaatgtatgaactgcttagattaattccctgcataaagttagtgcttaaaagtactagctgttgttgctgttattttattggttctaaaatattttctgaaaacctaccatagcattatagaacaaaaatattccatgaatacagcaacaataatatatagcacttttgyagcatttcacacatagcaactaatttaatcttcacaacacccttatgaggaaggaaacattaactccactttacagataaggaccccaagatactgaaaggtgaaataacttcaagtcacagtaagtcacagtaagttgtggaacagagatactaatccaggaaacaagctcttaactactatgctttactcactctcttcaatgacgaccaaaaattttttttttaggattatgagtgatttttattttccttattcttttccatatttttccattttttacaacaaatacatttttca

SEQ ID NO: 206717 - DNA, 601 bp, Human
tcactgcaacctccgcctcctgggttcaagcaattctcctgcctcagcctcctgagtagctgggattacaggcaggcgccactacgcctggctaaattttttatttttagtagagatggggtttcactacgtttgccaggatggtcttgaactcctgacctcatgatccgcccacctcagcctctcaaagtgctgggattacaggcgtgagcaactgcacccagcccttattcttaaattgtaagttaacaaactttagtgtctagcattttctcaactataaatcttttaccaaatattyttgtgtacctatagaattatgaatatacagtaacctcattgagattaatcataaaatcaacactagattccaatattaactgtttatactgcattttgtttgttttactttatgtatctaaaatttgctaacagtatgactgtatccagtacatggatggatactgtatctagtacatggatggatactgtatccagtatccatcatatctcctaacttgccttcaaacatctgttggctggttaaaaaaatttaatcttggagatgaaaatttaccaaaacaggatattaaatgttttc

SEQ ID NO: 206718 - DNA, 601 bp, Human
acaaaacagacactagcatagtaaaaagctaactttactgatttgttatgaaattaacatacaattaattaagattttattacttgtgtgttaagtctggactacacaggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacartaagacttagtataaattaccaccttttaatggactagaacccatcttatatccacatttccttaaaaacaggtgagacataaccttactcatgtccttactcttttttttttttttttgacatgaaatctcactctgtcgcctaggctggagtgcagtggcgcgatctcagctcactgcaacctccgcctcctgggttcaagcaattctcctgcctcagcctcctgagtagctgggattacaggcaggcgccactacgcctggctaaattttttatttttagtagagatggggtttcac

SEQ ID NO: 206719 - DNA, 601 bp, Human
agtgattgaaaagataaacatgaaaagaagatgattgctagtatcaggaaaaaaacaaaataaaaacaaggagtaggattaggaaacaaatacaaatttttgactttttgtatgtaaatggaaacagaaagcaaactgataaaaagccagtgaagacaaagattcagtcttaaagataatcaaaaagacagacacaaaacagacactagcatagtaaaaagctaactttactgatttgttatgaaattaacatacaattaattaagattttattacttgtgtgttaagtctggactacactggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacagtaagacttagtataaattaccaccttttaatggactagaacccatcttatatccacatttccttaaaaacaggtgagacataaccttactcatgtccttactctttt

SEQ ID NO: 206720 - DNA, 601 bp, Human
aaagtttgggggaaacactacctatattaagccccaagaaatcttatagcaaataaacctaattaatgtgatatcagctagtgtttctgaactttgagcatgacatacttgtgagacagtctctcaatactcttcaaaccattgttctttgaagttcacaggtcaggaaaaccgtgagtttgatgatggttttagacaacaaaaagcaaagaaatccctccaactgttccaatataccattctaaagtgctttcaattcagtttaccaaagagataatttccttcattagaatattccttstaagaaataaaagaatttgaataaattagtgatacaaatcagttcctaaaacctacaaattcagtcatgatgtgtgattctgggtaatccataccaaatccttcttttgctgctcttcatagctgaaaatatttacaaagtaagataaacaaataactaactcaaaagatgatacgacaccataatcacattactaatgtatttaccaatatctggattgaagatttcctccacaaccagctgaaaaaattctttggaaacacctccctcatcaactccttgttctccttcaaattccac

SEQ ID NO: 206721 - DNA, 601 bp, Human
gagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatcagaaatcaaattatacagtatrtaagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgacaaataattacaattaataaatt

SEQ ID NO: 206722 - DNA, 601 bp, Human
gaggtggaggttgcagtgagccgagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatyagaaatcaaattatacagtatataagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgac

SEQ ID NO: 206723 - DNA, 601 bp, Human
atcttttaaactctgatatagaacctagcaaccagaaatggtaaattgaggccaccatagaactacaaaatacaacaaataatttatatcactcttcttagaagacaacaaaaatcttatcaataaaaattgtaaaaagtgtagacagtatccctccagtcccccaaatagtttccaacctataaaagaaagattgtcagtcactgtgatgtcccattctctgctgagaaaccccataccaccaatttagcaatagaattcacactgtgctctatgagaaattctgtggtgtctcaaggtrggggtgggggtggtaggagcaggcacactcgttgtaactaccaagacccttagccagggctactctgatttttacctatctcttaagatttcactaaaacacaaacaaaatgtttagaaacacttctctatgaaatcaatcttacaaaagcttcgtgctgacagcaatatataaaaatgtccccctttgagtttttaagtgtttctggtacttcggtcagattaaaacatttttatcttattgataagagtatcaacaaagattctaaacaaaaactttaaaattttgacataaattaaa

SEQ ID NO: 206724 - DNA, 601 bp, Human
caaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaaatctgacgtaaagwatacttttcagaaatgtatttttatcacaaacaggatatacatgtgtaaattaaatgtaatttttatttgttctgtgataaagaccttaatcatgaggttcctgcttacagcttaatacaagaaacaccctgcttcttgctttatactacaaccacacttagctattaactatctcctgcttcatgtcctctttctctaaaaggggctttagtgcccaactgtgtgctttcataccaacttatatccaagatttagaaaagtggactctagcatttacataaacttagttacttgttttt

SEQ ID NO: 206725 - DNA, 601 bp, Human
gccatatacataaaactgtcaagaatattcttaaaaattcaattttacacctacaaagaaaactacttcttacaatttcacaattctctgttacagccaatattaagctatgaaaaggccatatacacaaaactgtcatacttataaatgtcaatttcgataatgtattaaacagaactgaatataaatgctggagacgcagaaaattctttaggttctctcaactaggtatgtaaacagacacatttaaaccatgtatccatctatttataaatgccaaccgttttaagagagtacaatrtatttgatttaagcaaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaa

SEQ ID NO: 206726 - DNA, 601 bp, Human
taacatttattgctagatagagttgatattcattctagtgtttatatacttgagtcttagagcaatagcctttggagacaacttccaggaaggtacgtgtttgcatgccttctcactgcaatccatcagtagctgccacttgaaccagtcttagcaggggatggggaagcctatgtctttcagaattggatgatgtagtacacagaagtagacagtagagtagtaagggcatttgcttaaaagcagatagaactgggaacctctacatctttctgtgagaattcagggcttagttttttarggtgtaaaatggaaatactagtatgtatctggacatattatcttaagaattaaataaaagactaccatttcactcaaaaagtgcttgatcctgggaagccatgtaacagttcacaaatgcagagttcaaaagaaaggaaaaattgcagacatggtagccttattttaattatcttctaaccagcagtaagcatactctaaccagtgaggaatactagataatccatacgccaaatgcaggagattacatgagacttatatataacaacacttcattcatgaaataaatcacaagattagc

SEQ ID NO: 206727 - DNA, 601 bp, Human
cttagagacatctttccaaatgtccttccttgtcactttttcaaagttaggagcagggattgcacgtttttttgattggtaatttttgtttcaaaggtttgattcagattcagagttgattttgctaggtatggtggctcacgcctgtaatcccagcactttgggaggccgaggcgggcggatcaccagaggtcaggagtttgagaccagcctggccaacatggcaaaacccttatctctactaaaaatacaaacattagccaggtgtagtggtgtgcacctgtaaccccagctactcagraggctgaggcaggagaatcacttgaacccaggaagcggaggttgcagtgaactgagactgcgccactgcactccagcctcagtgacagagcaagactgtttaaacaaacaaacaaaaaattaacaaaatcttatttctagtggtttacatattaatgatgctggcaacttttagttgaaatgtattaaacagcctcgcagtttttatttttatgaattctgcatacaataaataaataccaaccaaaatatctatacaggcataccccagagatactgccggttcagtttcagaccatgg

SEQ ID NO: 206728 - DNA, 601 bp, Human
acaccaccattattaccaccacattgataacattcagagagcagttagggaatcacattattttgaaaattagtaagtaatgggaaagaattaagcattatcgtatatgatatgtacatatttatatacatgtatacagatcctatatgtggatctgtaatttagggtagtcatagagttgatgagaaagagtttttcttaagaagtattacaggtaataaaggaaggaggaataaagaattcgagtatcacaattttgtaaccctcaatgaattagcagatctaggcaatcagaatccaygataaaaattactagaaaagacagaaagcgagtgagacttttaagttattcctacaaaccaacatctatgaagtatttgggaaggaaataaactctgaatctgtttttcgtttttttgagatggaatctcactctgttgcccaggctggagtgcagtggcacgatctaggctcactgcaacctccgcctcccaggttcaagcgattctcctgcctcagcctcccgaggagctgggattacagctgcctgccaccaaacccagctaatttttgtatttttagtagagacggggtttccccc

SEQ ID NO: 206729 - DNA, 601 bp, Human
agcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccaaagataactgaaaccaaaaaaaagcaaaactaaggataagacatactrctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgcaacactactctataattttttaaaaggcactataaatcaatgcaata

SEQ ID NO: 206730 - DNA, 601 bp, Human
acctgtagtaccagctactcagagggctgacgtaagaagattgcatgagcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccamagataactgaaaccaaaaaaaagcaaaactaaggataagacatactgctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgc

SEQ ID NO: 206731 - DNA, 601 bp, Human
tctgaatgagggtaactgaaaaaaaggaagacatgacacaactaaggagtaattagaaatgcaaggaaaaaaatcccatcaaatacaaagaaactaaaactaaactagaagaaacataaaggtgaataaaacagaacaataataccagaacctgaaggcagaagaaaaatcttaaaatcaaaaagaaacaaacccatgcttgagactctccttgctggtccagagccacagtgctgctgtgtactggcaggaggaattctgctataattggtcctggcagtgttcacctttcctgcaagtrttccacagcccagggacacaatgtggtcaggagcactgccaggaacaccagcaagggggagcctgccacaacaggcacaaggctcaggaagcactctccagcccacgaaaatctagtgggggtcctcttccctcacccaaacacactctgcgcagctcagcctggagaaggcccctcaagcagcactactaggaaccagtgcgagccccagtggactgagataaaagcaacaaaccaaaacagcaccataaagcctctgaaaaatggtcactggaaccacagctcacaaatatatgctag

SEQ ID NO: 206732 - DNA, 601 bp, Human
ctattttatcatgccttttctgtagaactgtttttcaaggtaatcaaatggcacccaatgatgagaaaaaagaatgccaggtatatatgtaggacaagcagatggaaattttttttccccaaacagccattttgcaatccccaatgagataacagattaaggtaatgatactgataaatacgaaaatcaggtgaagggcaggtagcaggttctggaaagatgatgatggcaacgacatagttattattattattattttttgttttattccctcccaacctcccctacaaaaacagcaaaytgaatgagaaaaccaaagacccagagacattatctacaacaaaaccatgaaccattgcatataattggacagaaacaaagctctgacaactacaagactggttagtaaggaagcagatgcaaggtaactgactgggtttctgacagccctgagaacactgccaacccactggaaagcacaggccaatctgaaaacagggcttaaagttttaaaaagttctacaggatctaatttgcagatgattacaaagggatcatgatgtagtaagctctgggcccttaaaacacccgaataccaaac

SEQ ID NO: 206733 - DNA, 601 bp, Human
acagaccaccagtgatgagaaatacaaattcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggyaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttgga

SEQ ID NO: 206734 - DNA, 601 bp, Human
gagaacatcacacatcccaaaccagtaattacaattttctaccttttgatattctaatatcccaacatactatttttattaccaaaatgctggcatttttggtgctgcaacaccatttatctgaaataacttaaaagttttattagaattcttggctttctccaatctcttgccacttcccttccctgcccctttacaaatccaccagtcagcaagagaaaacaaaaaagaaacacacaacaacagaaaactggacatgaaacttgcaggagcatctctcaggtaaggaggagaggaatcrgaccccagttcatgatactccttttggggaggctgacaagagaaaacaagtctgctgtagcacagaaccctccaacatagcagaaaagctgccctgcagtgggtggtaataaagcctcctcacactgcaggagggctctgaagcttaactgaaccagctacacctaaggaggtagaccaaagagcaccaccgaagaacagagacagaccctgcaggaagtggcagatcagcagtggtcacaatgaccagtctggctatattattacggagctgtttctttggacttttaaacgaaacctt

SEQ ID NO: 206735 - DNA, 601 bp, Human
gaattgaaaaagactgaaatgaatatttggaaaaattaactccaggtgcctttgggtatatattttatttatcctttctcctttattctcctggtctactcatcctttaactcaactttgggaggaaaaagtgatacagattaaggacaaaagaaaaaaagaccccctgccccaaccaactggccccaaatgcaaacaactacatacctaatagcagtaatacaaaagttcaatttttatatgaactagaatactttaaacaagtaatatgtgctgtgtatggaggaggagaattattctracatttctgccacctgcagttattttaagagaatgatttatcctgtggcattcctaaaatctatgtaataaaagctatgttttaatgacacttatgttagtttgagttctaaaaaacgaaatacaagctcataaagtgcaatcttgaagtttatttgaataatcaggcatctataaaacatatatacactagttcatagctaaataaatttttttttttttgagacagagtcttgctctgtcgctcaggctggagtgcagtggcgcgatctcggctcattgcaagctccgcctcctgggt

SEQ ID NO: 206736 - DNA, 601 bp, Human
tttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacctaaatagagaaaaggggaaaaaaacaggaaaactgtaagtcatgggaaatacacttagaattaaatgctcctatttttagattgtatatagttgagacggtctgcaatgcaaactatacattaatgcaaatcataaactttttgttgtgtractaccaagttgcctttatcctataaattactcaaagctagtgacgatgataagatactgtatccattgagtttttactacataacagataccattttaggtactgaattcttacagttcatttaactaaatctttccacaacaaaaccacagagaggacatcagtaaatgcactttagaggttaggtcactgagaagtcaagtaacttcctctaaggtggagaaaatactcaaacctgttttacaagactgcaaagtgtgtgctcttaaatgcttattagaaacactgctggcaatatg

SEQ ID NO: 206737 - DNA, 601 bp, Human
tcaactcttgtttttccttttcaagatgattttagttaatctgggtcccttgcattttcatatgaattttttgatcagcctttcaatttctgtaaaaaaggcagctgtaattttgagaaagattgcattaaatctatagattagtttaggaagcgttgctaacataacactagtaagtctttcagttcatgaacatggatgtcttttgatttatttaagccttctttaatttttctcaacaatgtattgtataagttttcaatatggaagtcttattcttcctttgttaagtttatctcaragtattttgttcattttgatgctgttgtaaatgggattgttttctgaagtttattttcaggatgttcattgctactatgtggaaatacagtttatttttatataactatattgtatatttatgtgttgtatcctgcagccttgccgaactccttgattagttctaattgatttttgtgcatttttagaattttctatatgcaagatcatgtcatctgcaaatagaggttgttttacttcttcctttccaatctggatgtcttttttatcttttgtctaattgctttggctagaacctcta

SEQ ID NO: 206738 - DNA, 601 bp, Human
tatttatttatttattttggtgagatggagatttactcttgttgcccaggctggagtgcaatggcatgatctcggctcaccgcatcttccgcctcccaggttcaagcgattctcctgcctcagcctcctgagtagctgggattacaggcatgtgtcaccacggcccagctgatttttgtatttttagtagagacggggtttcactgtgttgcccaggctgatctcgaactcctgatctcaggtaatccgcccgcctcggcctcccaaagtgttgggattacaggcgtgagccactgcgccyggccggaatccttttaatattccacagaaaatttgggggaaatgctgacatacaataagagattgaccagatgactccattccctggctgtactaaatctcactttaacatttggggaatgactatgagttttgtttaaatattgggaataattattttcatctcttcccaagttcaccacagaaccactttgtagatgccacagattactcacatttgctgtcatcaggttattaagacatttttccttcagttagaaatggggtaaggacttagcttctttgtggtagtgatcacatt

SEQ ID NO: 206739 - DNA, 601 bp, Human
taatttagctttggcaaatttgggtgaagaatatgcaaaaattatttgtcatacttttgcaactttactgtaaatcagaaattatttaaaaataaaaactagttggtttctcatcctctgaaggtgaccacatagatttttttaaaaagttataaatttatgaatttaaacatatttgataattttcagtccattgaaattacctttattgaaaatcacattgtcttgtctttggctcctgagtccatttacatgatcttagtagggtttgtttgtttttagttttttgttgttatttttttttgtttgtttgttgaggcagggttttactgtgttatccatgctggccttgaactcctcagctcaagcaatattcctgccattgcctcctcagtagctggaaccacaggcacctgccactgcacctggcttcttgtagctttttctggtttacttcctatctaagataggatataccaggctcatctcatatagtccctatcccagacctggaattagccatttctttagaagtattggtttctttctgtgggaaagggtatttcaagattatagtctggttgctagagatattcatgat

SEQ ID NO: 206740 - DNA, 601 bp, Human
agcctcagaatgacactaacacagttgtcatcaacatgagtactaaaaacaggcaataatttttcttcttcctatttctctcagcccccattttttgagatctttcttcttttttgatgttggtgtttaatgctatattataatattataaatccctctcagaactgcttttgctgcatccttaaagttttggtatgttgtgtgtccattttcatttattgcaagatttttgatagtttcctcttaatttcttctttgacccattggttgtacagaagcatgttgtttaattttagaaatwcttctttttactggtttctagtttcataccattgtgattagaaaacgtatttgatgtgatttccaactgcttaaattagtcaagacttacttggtggcctaacatatgatctatcctggagaatgttctgtgtgtgcttgagaagaaggtgtatcctgctgctgttgggtggaatattcaaaatatgtctgttaggtcctcttgatctcaagtgtagttcaagtacaatatttccttattgattttctatctagataatgtgccattgctgaaagtgggatatctactatctctatctac

SEQ ID NO: 206741 - DNA, 601 bp, Human
acacagttgtcatcaacatgagtactaaaaacaggcaataatttttcttcttcctatttctctcagcccccattttttgagatctttcttcttttttgatgttggtgtttaatgctatattataatattataaatccctctcagaactgcttttgctgcatccttaaagttttggtatgttgtgtgtccattttcatttattgcaagatttttgatagtttcctcttaatttcttctttgacccattggttgtacagaagcatgttgtttaattttagaaattcttctttttactggtttgtagtttcataccattgtgattagaaaacgtatttgatgtgatttccaactgcttaaattagtcaagacttacttggtggcctaacatatgatctatcctggagaatgttctgtgtgtgcttgagaagaaggtgtatcctgctgctgttgggtggaatattcaaaatatgtctgttaggtcctcttgatctcaagtgtagttcaagtacaatatttccttattgattttctatctagataatgtgccattgctgaaagtgggatatctactatctctatctactatttctgtattgcagtc

SEQ ID NO: 206742 - DNA, 601 bp, Human
aattgaattggtggttacataacctttccttccaaaaacatgcaaaaccagatggtttcaatggtgaattctgtcaaacattaaaaaacaaaacaaacatcagattctacataaactcttccagaaatttgcttgtttgtttagagaatagggtctcactctgtcacccaggctggaatgtagtggtgtgatcatggcttactgcaacctcaacctcctgggctcaagcaatcctcctgactcagccttccaagcatctgggactacagatacatgccaccatgctcagataattgttttwttttttttgtagtggcagggtcttattatgttgcccaggctggtctcaaactcctggcctcaagccatcctcctgccttacctcctgaactactggggttatagacatgaaccactgcatccagcctcatttaacttattcagtactcattatcagtccatattcaatttccatgttgtcattttgttttgtgattgtgatgcttgttctccagaagatatctcaggtgttaatgggaacaatattctctgagtttttatacattgataatagtttgtgccttttatacttgaaggtcaa

SEQ ID NO: 206743 - DNA, 601 bp, Human
aaaccagatggtttcaatggtgaattctgtcaaacattaaaaaacaaaacaaacatcagattctacataaactcttccagaaatttgcttgtttgtttagagaatagggtctcactctgtcacccaggctggaatgtagtggtgtgatcatggcttactgcaacctcaacctcctgggctcaagcaatcctcctgactcagccttccaagcatctgggactacagatacatgccaccatgctcagataattgttttattttttttgtagtggcagggtcttattatgttgcccaggctggkctcaaactcctggcctcaagccatcctcctgccttacctcctgaactactggggttatagacatgaaccactgcatccagcctcatttaacttattcagtactcattatcagtccatattcaatttccatgttgtcattttgttttgtgattgtgatgcttgttctccagaagatatctcaggtgttaatgggaacaatattctctgagtttttatacattgataatagtttgtgccttttatacttgaaggtcaattttgctggatattaactagtggttcatattttcttttcttgat

SEQ ID NO: 206744 - DNA, 601 bp, Human
gatttaatatatgtatatattctataatgattaccacaatcaaaatgacacatctgtcaccactcatgctgtacattagatcctcagaactaatcttataactgaaagtttgtaccgtttgaccaacatctccccatttcccctgctttcccagcccctagcaaccactgttctactctcctcttctatgagttcaacttttttacatgccacgtataagtgagatcatagagtgtttgtcttttctatgtctgacttatttcatagtgtcctacaggttcatccatgttgtcacaaatgkcaggcaggctctattatggctagagaatattctatggtatagttaaaatgtggaatctaaaaccatggtaatgaactttttgtattccgttacattgaactctacttttcttggtactttcaatggatctttttcccatttaaagttgattttgaaacatgtatcagtcatttggataatatggttcactaagttatgcaaatattccccttgttaatacattttataatattaaaatatcacattcattaatatcaccattgatctcatcagaaaagtctttaagaattgagaagctaa

SEQ ID NO: 206745 - DNA, 601 bp, Human
aaaggccccttggctccctcctgcatagacactgataatagtgggtcctgtggcacttggcggtttggccctcatccacctgtattttgaggtttgtggggatactttatcacttaggcttttttcagcagtcaaatgcattacttattgaagtataatttacagacaataaaatatgccttttaaggtaatcaattctatgagttgggcaaacattttcaaacatgtaactatcaccacagtcagtgtatagaattttctctgtttttcttttttcttcttcttttttttgagacaagakctcactctgttgtccaggctgaagtacagtggcatgatcacaactcacttcaaccttgaattcctgggttcaagcgatcctcccaccccagactcccaagtagatatgactacaggtgcatgctatcacgcctggctaatttttaaaatttgtacagcaggtctcactatgttgcccaggccagtcttgaactcctagccttaagcaattttcctggttcagcttcccaaagctatgggattataggcttgagccaccatgctcagcctaatatatgaatttttcatcaccccccaaagt

SEQ ID NO: 206746 - DNA, 601 bp, Human
ttgttaggcaattttgtcattgtgtgaacatcgtagagttgacttacacaaagctagatggtatagcctattgcatatctaggctgtatggtatagcgtgttgctcctaggctacacacctgtatgacatgttactgtactgaatactgtaggcacttgtagcagaattgtatttgtgtatctaaatgtagaaaaggtacggtaaaattatggtatcataatctcatgaaacaaccattgtatatgtagtccattatttactgaaatgtcattatccagtgcatgactgtacattgctggkgggaaggtggtcagtaccaccacttcagaaaacagtttgtcactgccctgtaaaatcaaacattggcatattctgtgacctgaattgccacttttgagtatacccttaggaacctgcaaatgtacacgtggtgactaggtgattttttttttttttttttttttttttttgagactgagcctcactctgtcacctaggctggagtgcagtggcgccatcttggctcactgcaagctctgcctcccgggttcacagcattctcctgcctcagcctcccgagtagctgggactaccggtgcc

SEQ ID NO: 206747 - DNA, 601 bp, Human
agagttgacttacacaaagctagatggtatagcctattgcatatctaggctgtatggtatagcgtgttgctcctaggctacacacctgtatgacatgttactgtactgaatactgtaggcacttgtagcagaattgtatttgtgtatctaaatgtagaaaaggtacggtaaaattatggtatcataatctcatgaaacaaccattgtatatgtagtccattatttactgaaatgtcattatccagtgcatgactgtacattgctggtgggaaggtggtcagtaccaccacttcagaaaacwgtttgtcactgccctgtaaaatcaaacattggcatattctgtgacctgaattgccacttttgagtatacccttaggaacctgcaaatgtacacgtggtgactaggtgattttttttttttttttttttttttttttgagactgagcctcactctgtcacctaggctggagtgcagtggcgccatcttggctcactgcaagctctgcctcccgggttcacagcattctcctgcctcagcctcccgagtagctgggactaccggtgcctgccaccatgcctggctaattcttttatattttt

SEQ ID NO: 206748 - DNA, 601 bp, Human
tatttgtgtatctaaatgtagaaaaggtacggtaaaattatggtatcataatctcatgaaacaaccattgtatatgtagtccattatttactgaaatgtcattatccagtgcatgactgtacattgctggtgggaaggtggtcagtaccaccacttcagaaaacagtttgtcactgccctgtaaaatcaaacattggcatattctgtgacctgaattgccacttttgagtatacccttaggaacctgcaaatgtacacgtggtgactaggtgattttttttttttttttttttttttttttgagactgagcctcactctgtcacctaggctggagtgcagtggcgccatcttggctcactgcaagctctgcctcccgggttcacagcattctcctgcctcagcctcccgagtagctgggactaccggtgcctgccaccatgcctggctaattcttttatatttttagtacagacagggttttaccgtgttagccacagtggtcttgatctcctgatctcgtgatctgcccacctcggcctccaaaagtgctgggattacaggcgtgagctacggcgcctggccaactaggtgatgtttata

SEQ ID NO: 206749 - DNA, 601 bp, Human
aaaggtacggtaaaattatggtatcataatctcatgaaacaaccattgtatatgtagtccattatttactgaaatgtcattatccagtgcatgactgtacattgctggtgggaaggtggtcagtaccaccacttcagaaaacagtttgtcactgccctgtaaaatcaaacattggcatattctgtgacctgaattgccacttttgagtatacccttaggaacctgcaaatgtacacgtggtgactaggtgattttttttttttttttttttttttttttgagactgagcctcactctgtcrcctaggctggagtgcagtggcgccatcttggctcactgcaagctctgcctcccgggttcacagcattctcctgcctcagcctcccgagtagctgggactaccggtgcctgccaccatgcctggctaattcttttatatttttagtacagacagggttttaccgtgttagccacagtggtcttgatctcctgatctcgtgatctgcccacctcggcctccaaaagtgctgggattacaggcgtgagctacggcgcctggccaactaggtgatgtttataaaaatgtttatagcagtggtat

SEQ ID NO: 206750 - DNA, 601 bp, Human
acggtaaaattatggtatcataatctcatgaaacaaccattgtatatgtagtccattatttactgaaatgtcattatccagtgcatgactgtacattgctggtgggaaggtggtcagtaccaccacttcagaaaacagtttgtcactgccctgtaaaatcaaacattggcatattctgtgacctgaattgccacttttgagtatacccttaggaacctgcaaatgtacacgtggtgactaggtgattttttttttttttttttttttttttttgagactgagcctcactctgtcacctagrctggagtgcagtggcgccatcttggctcactgcaagctctgcctcccgggttcacagcattctcctgcctcagcctcccgagtagctgggactaccggtgcctgccaccatgcctggctaattcttttatatttttagtacagacagggttttaccgtgttagccacagtggtcttgatctcctgatctcgtgatctgcccacctcggcctccaaaagtgctgggattacaggcgtgagctacggcgcctggccaactaggtgatgtttataaaaatgtttatagcagtggtattcataa

SEQ ID NO: 206751 - DNA, 601 bp, Human
ggctcacgcctgtaatcccagcactttgggaggccgaggtgggtggatcacaaggtcaggagattgagaccatcctggctaacacggtgaaaccccgtctcaactaaaaatacaaaaaaaaattagccaggcgtggtggcaggcacctgtagtcccagctactggggaggctgaggcaggagaatagcttgaacccaggaggcggagcttgcagtgagccgagatcgctctaccactgcactccagcctgggccacagagcgagactccgtctcaaaaaaaaaaaaaaagaaaagaaaatmccgcatagaattcaaggttttttctttttcttttcaatgatactattaaactaatacagtgaaacctccaatttaacttttgcttaaagaacacatcaatatctttgatgttctggtaaaataatggttttttattcagccgtgcaccttggtatatgagcacaggcttaatggtcttttgaaaaaaaattatcttccatatccaaacttcaaagactctagatgttttcacaaaagaattgaggctgtagtttcatctttggaggtattaccctaagttaggtagttctttcaagaacc

SEQ ID NO: 206752 - DNA, 601 bp, Human
tctaaaacattgatgaaagaaattgaagtggacaccaaaaaatggaaagacatcccatgctcatggatcagaagaattaatattgtcaaaatgaatacactgcccaaagcaatttatagattcaatgcaatttctatcaaaatatcaatgatattctttacagaaatagaaaaaaatcctaacatttatatggacccacaaaagactccaaataggcaaaacaatcctgagcaaaaaacaaaactggaggcattacactacctgacttcaaaatgtactacagagctatagtaaccaaatytgtatggtgctggtatagaaacaaacacatagagcggtggaacagaatagagaacctagatatagatccctgtacttacagccaactcatttttgacaacggcaccaagaacataaaatggggaaaggatagtttcttcaataaatggtgctggggaaactggataaccctatccagaaaaatgaaactagacccctgtctctcaccagatgcaaaacccaaaatggattaaagacttaaatttaacacctgtaattgtgaaacttctagaagaaaacattggggaaacactccaggacg

SEQ ID NO: 206753 - DNA, 601 bp, Human
tgtaaacctagaattctttactttgctaaattattctaaaatgaagatgaaataaaaaccttttccataatggtacagccactgcagaaaacagtttgggagttccttgaaaagttaaacatataattactatgtggcctagaaattccacttttaggtatataccccaaaaaactgaaaactccaacagtacttgtacacaaatatgcatagcagtatttttcacaatagccagaatgtgggaataatccaaatgtccatcaacggataaatgtatgaactaattgtggtatagtcatgygtcacttgacagtggagctgtattttgagaaatgtgtcaggtgattttgcagttgtgtgaacactacagagtgcacttattcagagctaaatagtatggccttactgtgcatgtaggctatatggtagcctattgctcctatgctacaaatctgtaaaagcatgttactgtactgaatactataagtgattgtaacacggtggtatttgtgtatagaaaagatacagggaaaatgcagtattataatctaggatcaccatcatatatgtggttgatcgttgagcaaaacatcgttatgca

SEQ ID NO: 206754 - DNA, 601 bp, Human
tgaagacaggttaacagaaattattcaaactgatgcacaaagagaaaaaagatagaaaaaattaacacatcatcagcaacgtgtaaggaaatattaagaggtctaacatacatataattggaggtgcaaaaaagagaagagaaagaatagggcatacaagtgtttgaacaaataatgtcccccaaattccaaatctgatgacagacaacccacagattcaagaagctcagtgagtaaatatgaaacacctatgcacactattaaattactagaaaccaacgataaagagaaagcttaagaygacagaagaaggaaggctaaaaaaattggggggaggctgggtgcagtggctcacatctgtaatcccagcactttgggaagctgaggcaggtggaatgtttgagctcagaaatttaagatcagcctgagcagcatagtgaaaccccatctgtaccaaaaatacccctccccccaccaaaaaaaatatgtatgtcgggcatggtggtgcatacctgtggtctcagctacctgggaggctgaggcgggagaatcacttgagcctgggaagcagagattgcagtgagctgagatcacgccactg

SEQ ID NO: 206755 - DNA, 601 bp, Human
cacatctgtaatcccagcactttgggaagctgaggcaggtggaatgtttgagctcagaaatttaagatcagcctgagcagcatagtgaaaccccatctgtaccaaaaatacccctccccccaccaaaaaaaatatgtatgtcgggcatggtggtgcatacctgtggtctcagctacctgggaggctgaggcgggagaatcacttgagcctgggaagcagagattgcagtgagctgagatcacgccactgcactccagcctgggcaacagagtgagaccttgtctcaaataataataataakaataagaagaagaatactcactgacctttaagaaataattgaaagccaaattatatatatattcaaaattctcttctaaaaataaaagctttttaggtgaaaaaaaaaactgagaggattcatcactaacatttccacaactaagaaatactaaaggaaattctttaggtgaagagaaatgaaacccagatatgtaggaaggaatgaagaacaccataaatgctaagtatgtgataaatatgaaatcccttttacctctttttaaaagtcctttaaaagataattaactgtttaaagcaa

SEQ ID NO: 206756 - DNA, 601 bp, Human
aaaattgaccagtgggacctacgtaaactaaagagcttctgcacagcaaaagaaactatcaacagagtaaacagacaccctacagaatgggagaaaatatttgcaaactatgcacctgacaaaggcctaatatccagaacctataaggaatttaaataaattcacaaacaaacaaacaaaaaaacccttttaaaaagtgggcaaaggacatgaacagacacttttcaaaagaagacatacatgtggccaacaagaatatgaaaaaaagcccaacatcattaatcattagagaaatgcaaaycaaaaccacaatgagataccatctcacaccagtcagaacagctattattaaaattcaaaaaacagatgctgatgaggatgcagagagaggggaatccttatacactactggtgggactgtaaactagttcagccactgtagaaggcagtttggagatttctcaaacaacttaaaacagaactaccattcagcatggttgcagctggaggccattatcctaagcaaactaattcaggaacacagaaccaaatactgcatttttttaaataagtgagaactaaacattgagcatatgtggac

SEQ ID NO: 206757 - DNA, 601 bp, Human
tgcaaactatgcacctgacaaaggcctaatatccagaacctataaggaatttaaataaattcacaaacaaacaaacaaaaaaacccttttaaaaagtgggcaaaggacatgaacagacacttttcaaaagaagacatacatgtggccaacaagaatatgaaaaaaagcccaacatcattaatcattagagaaatgcaaaccaaaaccacaatgagataccatctcacaccagtcagaacagctattattaaaattcaaaaaacagatgctgatgaggatgcagagagaggggaatccttayacactactggtgggactgtaaactagttcagccactgtagaaggcagtttggagatttctcaaacaacttaaaacagaactaccattcagcatggttgcagctggaggccattatcctaagcaaactaattcaggaacacagaaccaaatactgcatttttttaaataagtgagaactaaacattgagcatatgtggacacagaaaaggaaacaggagacatggaggccttcttggggtggagggtaagaggagggtgaggactgaaaaactacctgttggatactatgctcattacctg

SEQ ID NO: 206758 - DNA, 601 bp, Human
tgcttatatgcatgttataatttatgattttgcaggtactcatgaattagtatagtattcaaagcaattatatatatatgatagttaaggaacattttgtaatattcatatgacacttaaatctatgtatatgtaggtctagttctaacatgtagcataataccaatataattttgtgcaataacaatttaatttctcttatgctactttgttactaaacttgaacatatatgcagacacttttggtatactttctaatcttaagtattatttttatagatttcagttgctgtccccaackgaaacttcagcctagtgaagtttctccaaatttagattaataaaaaactttaaaaactacatgactcaagaaaagttgtctaatttggcattaataataatggaacaaaaattatgtaaaaaccttaattataacaacataatgaagcaataaaaatattttattgattagaaatacaatatttaggagtctatgtatctttattctattattcaaatactacaaactcttcagcaggacacctagtcatgtgtaataataattatattcaatctttagtattttgcctacttccaatta

SEQ ID NO: 206759 - DNA, 601 bp, Human
gtgcctgtagtcctaactactcaggaggatcccttgagcccaggatttcaaggttacagtgagctatgatcaccccactgtactccatcctgggtgacatagcgagaccccgtctctaaaaataaataaataagtaaataaataagctttaaaaaataaaaaggagtagaaattaaggaaattaataacaatggagaaaataagtgaaaccaaaagccagttctttgaaatgttcagtaaaattgctaatcctttagtcagactaaccaagataaaagaagaactgaagtaccaagatcaraaatgaaagggattgttgttgctggtcacatgggcattagaaggataataaaggaatattatcaacaactctgtgttcagatttaaaaaaaaattttgtggatacacagtaagcatatatatttatggggtatatgagatactttgatacaggcatgcagtgtataataatcatatcagggtaaatggggatatccgtcccttcaagcatttatcctttgtgttacaaaccaattatactcttgtatgtttaagtgtagaatttattattgactatagtcactctgttgtgctatcaaat

SEQ ID NO: 206760 - DNA, 601 bp, Human
cacagaacacagctattaggggcaggagagcctttgtgttgggcaaggtagatgtgtagatatcctaaaatatattgaatatgtatgtttaagtacacatattttagccaccagcatttttctatgtacaaagatccactgagtctttttttttttttttttttgagacggagtctcgctgtcgcccaggttggagtgcagtggcgctatctcggctcactgcaggctccgcctcccgggttcacgccattctcctgcctcagccttttgagtagctgggactacaggtgcccgccacctygcccggctaattttttgtatttttagtagagatggggtttcaccgtgttagccaggatggtctcgatctcctgacctcgtgatccgcccacctcggcctcccaaagtgctgggattacaggcgtgagccaccgcgcccagccaagatccactgaatcttttaaagtcagtgtagcccttattatgcttctatcctttgcttttcactagaaaatgattgtagcctatattgtaggatggcatctatgcagtcagtatcccatggtactgcatgtgggtgcattattgtagggtacaacac

SEQ ID NO: 206761 - DNA, 601 bp, Human
cctctgcctcccaggctcaagcggttctcctacctcagcctcccaagtagctaggactacaggcatgccccaccatgctctgctgatttttgtatctttagtacagaaagggtttcaccatgttggccaggctggtctcaaactcctgacctccagtgaatcaccttcctcagcttcccaaagtgcagggattacaggcgtgagccactgcacctggcccctgtggttttgatgtatcctggtgaattcatcatgcttacagttcagtgccaagattgctgttttataaaatgaggataayattattcaaaaccaatcaaattgtccctttgaacttttcctcccttgtggaggtagaggttgtagttagtatttataactaccttcttccacaatgcatttctgtattcctttgccttcagcaagcacctcagctggtgatggttctttacctggtggaatgactcagacctttattcctgaaggtctggtcattaatagtcgtgcttggattgggttgttgtagtttgctactgacataaatcacagggcatggtagtactacaggatgccctaagggatcttctgtattccacacata

SEQ ID NO: 206762 - DNA, 601 bp, Human
tgagacctttttttctagtatgggagtttaatgacataaactaagtcaatactttggggaaaatttatgccacaaattcttatatgctatgttttcattttcatgcaaaatgcattctaattccccttttgatttcttccatgacccatgggttgtttagaacaatattatttagtttccaaatatttggacattttccagaagagcacgttaatgattcctaattcaattcagttgtgatcacagaacatagttataccctgaatccttttaattttattgagacttgttttgtggccartaatatggccagtcttggcaagtgtcccatgtgcacttgaagagaatgtatattctgctgttagatgaagtgtgccataaatgccagtaggtcaggttggttgatagtgttgagcagatcttctatattcttactaattttctgactactaatttatcaactaataagaggagtattgaaatatctgcctataattttgcatttgtctatttctcctcacagtcctatcagctcttgcttcaagtattttgaagctctgttactatgtatataaacatttagaattgctatgtctttttc

SEQ ID NO: 206763 - DNA, 601 bp, Human
gtaagcaagtgacagcatggcacagtactagaagatttgcccccttggttcaaattgatttttttgtagagcggagggagcagggagctaggcctctattctcatgattcggtgatgactcaccaagctgtgggtaaaggagaactgattgataggtagtctaggactctgcttctcaaaacgtggtccctagactagcagcactggcatcacctgggagtttctttgaactgcagactgtcgagccccattctagatctatcatcagaatctgcactgtgacaagaaccctagctgattsttacgcgctttaattaagtttgagggagcgctgttctaagcgtgaatggtttcatatgccctctagtggctgtccagcaacttgcagggagctttaaaatgttttctcattttaggacctttgcacagaactgccgaaacattgaacatttgaacctcaatggatgcacaaaaatcactgacaggtaagtaatgaagattaattggtgaccaaatagccacggggagagagaagggagagaaacgtggttgaaaatatctttagtgcgtctgctctttttcagcacgtgttatagcctta

SEQ ID NO: 206764 - DNA, 601 bp, Human
ccctctacttattttgttgaagttatttggataaaatgctagtaatcagcaaccaaaactgaacaacagcagatacttttctgctgctcccgttttggtattgctggtgtcctctgacttttctttctgtgctgcttttcctcagcgtatcacggatgaaggtgtggtgcagatatgcaggggctgtcaccggctacaggctctctgcctttcgggttgcagcaacctcacagatgcctctcttacagccctgggtttgaactgtccgcgactgcagtgagtacactgcactttttgcttygcagctcagagtttggctgagttaaccaagagggcttccttcaggagaggacaggcttgccaggtagtggtggtggaggcagtagttatgttgttgttggcttttgttgggtaaattggggtggggcgtgtataaatccagttcattggaggatgtactgggagagtataaaatgtctaccaccagtgaatccaaactttaatttcttaatgaatgtcacacagtttcccacctaatttacctcatcatgttattgctttaagcacccgagtgagcacatagtgaggagagtgatagcct

SEQ ID NO: 206765 - DNA, 601 bp, Human
ttttacacttttagctcgggtaaggcatagatttaaagaatacaaccaaactctaattcacctcccgaattcaaagtgacttggagtggttttgggtgtgcaaaagactaccttcagaaaagacaggcacaaagtagagtagaacccttggggtgtgtactgcagtttttccagttagccagaaatctagggaagtcctatagagggttctgtaaagagtctgagcctcacgcgtggtcaagtgggaccagcctcctcctggcaggagactccattcctcattggaccccaacttggcctstcagcagctccccctaactgggctgtactctgccctttgtcctgcaaacactgaccactgggggcccctctggacctgctgccaggaacccatgtcctcctggggctgctgatatacttggctacctccacccaacccccacagtgtggcttagtgccccatccccatgccctcccagagtctaggctatggctaaaatttacctgctgatgtctgcgagccactgggaaggttgtagacaactctctttacaagttgagagaaggaaatgcagccagaggcagccctattcccagttcc

SEQ ID NO: 206766 - DNA, 601 bp, Human
taactgggctgtactctgccctttgtcctgcaaacactgaccactgggggcccctctggacctgctgccaggaacccatgtcctcctggggctgctgatatacttggctacctccacccaacccccacagtgtggcttagtgccccatccccatgccctcccagagtctaggctatggctaaaatttacctgctgatgtctgcgagccactgggaaggttgtagacaactctctttacaagttgagagaaggaaatgcagccagaggcagccctattcccagttccaaagcactgtaactyaaaaggcagctgttcagaagtgctggtttactgggtagctttaggaagagggcatacttcttaacagaagagaacaaggacactgggccaatactcagagggatagggcaagccaccattgttgctgtcaccactgactcacatgtggggtgtgtcttgtggactcttccagaattgccacgaattggagaagatggatcttgaagaatgcatcctggtgagtggactcctgacagccctgcagggcagcctgctccttagtcattgctggccagtgcagcacagccagagacactgact

SEQ ID NO: 206767 - DNA, 601 bp, Human
aatctattaattgggctaacttgggaggcaaggtatctaaatatttgattactgctttcattgaatttgcaattttaagattcccaaaagagaaatgtccagatccagatggttttgttggggaactctaccaaacatttaaggaatgaacatcttttttttttttttgaaacagggtctcactctatcgcctagggtggaaagcagtggcacaatctgagctcgctacaacctccacctcccaggttcaagcaattctcctcctcagccttgcggggggattacaaacatgcgccaccaygcctggctaatttttgtatttttagtagagacggggtttcaccatgttggccaggctggtctcgaactcctgacctcaggtgatctgcctgcctcagcctcccaaagtgctgggattacaggtgtgagctaccgcacctgacctgaattagcatcaattctatacactctgttttaggaaataagacagtaaaacattttacaactctttttttgagacagagtcttgctctgtcacccaggctggactgcagtggcgcgacctcagctcactgcaacctctgcctccttggttcaagct

SEQ ID NO: 206768 - DNA, 601 bp, Human
ctagggtggaaagcagtggcacaatctgagctcgctacaacctccacctcccaggttcaagcaattctcctcctcagccttgcggggggattacaaacatgcgccaccatgcctggctaatttttgtatttttagtagagacggggtttcaccatgttggccaggctggtctcgaactcctgacctcaggtgatctgcctgcctcagcctcccaaagtgctgggattacaggtgtgagctaccgcacctgacctgaattagcatcaattctatacactctgttttaggaaataagacagtraaacattttacaactctttttttgagacagagtcttgctctgtcacccaggctggactgcagtggcgcgacctcagctcactgcaacctctgcctccttggttcaagctattctcctgcctcatcctcccgagtagctgggattacaggcgtgcaccaccacgcccagcaaatttttgtatttttagtagagacggggtttcaccatgttggcctggctggtctcgaactcctgacctcaagtgatccacctgcctcggcctcccaaaacaactttttttttttaatgaggccagtaata

SEQ ID NO: 206769 - DNA, 601 bp, Human
ctgataagcatctaagtatttttaccccgcttctaaaacctgatgaggaattcaaaataagcacacagcattaaatgacatttattgttccataaatcttgagacccaaaaaggaatgctaaatagacaagcaaaacttttaaaacaaacgagataaactcacttctttccccagtgactggtacagaaaacatgtggtcacacgaaagcaaagggaaaaagtcagaaaggaaaactctctgcctataggatctataggagttacagatattttcaaatcgatgatgaaaatagatcgtgyttctttgtagcaaataattaaccccctttatgaataaaacataaaatgtcaaagcttttactcactgaagtagtttgtcttctgggagagatttcaaactcaaaattactcatttcctattttttgcctgaacacaatgaggatcaaatagtacattcaaatcaggacacctgggtatatggacaaagatatcctacaattaaaatggaatagaagttaaaaaaaaaattcagtcccctacaccacaggcctcaaacatgcttgctgatggattctgggaaggttttggatgaaggacgg

SEQ ID NO: 206770 - DNA, 601 bp, Human
ggtactgaatacagttcagtctatataagacatcacttcaaaattatgtggatgccatcactactttcagctgcagaaaaaggaaagacagtatttcttcagtcaggcttaggaaattaagcctattaaatggaaaactccctgccaactacaacctcccttcccaattcagaggttacctttaaatgattctagagaaacaagcagattaacttgctctagctcctcttcccccaaaaaacttcatgtacacattccctttttagacattctgcgaagcctggcccactatcaacgcccrcattccaacactgtctgccagttctgggggtagggggacatctatcaagacacacaataatagtgctgtccataaggggagcaagagctagaaggagaacaggtgaaatatactgtgtcagggcagaggacctgagggagtaaatgcaaatgtgtacatctaccttttccagaaaaatttctgagctactcacagagatttcaaacattttaaaaatgtatcattccttttgcctagtgtttctcagtaaatagtgagaagcaatataggcattcataaaaaaatgatttttctcatgac

SEQ ID NO: 206771 - DNA, 601 bp, Human
ccagactggtaatagtcaactgcctacttgacatttctacatatccaaaatcaaactcttggttgatttaccccaaccatacttacctcttcaatgagatcaccatctgcccagttactttccacagaaaataaggtgtcagaactattcctccctcaaaagtggagcccactgggaccctgtctataaacgtgtaagataccatcacctttcacctggatatctcctgcctcgttttgccaccttctcatctgtctccacagagttgtgaaagtgaaagaaaaatctagtcacattactrctcctttgtttaaacaacttcagtgacaacccaatgcatttcaagtaaatccgaactaccatcatcatccggtccccgcatgccagacccggcctcctgctttgatttgccctgatccgctcaccctcacacactgcatggcacctacatggcccactgccaggctttccaagaagccaggtgttttctttgcacacagccccacgttgcctggggatgctaatccaatggccagctcccgcttcttctcattcttcaagtctcaggattaataacacctcctcagagaagccttgcctt

SEQ ID NO: 206772 - DNA, 601 bp, Human
aagaggctctctttcatctctctactagggcttactacatgcacctcacagttgtgaccagagagtactgtgtatgtgtgtgcacacccttaacccatacagagaactggacagataactgcaatgtacaacccttcctgaaatgtgaatgcccccaaggatcagagcaagaagactcactgtcctcctcaccatgctactgtcagtgctgtgactcaggagatgtgcccaaagggtaccatggctagctcctcgcccactttcttggaagaagcccccaggataaggaaaaggcagaaggccacgccatgtgatcactgctcacagcgaaagggattaaaactcaccagatagaaacatggatttgcctgatgtaaaaggagtaatgtggggcctccttcagttccaaatgtcggcgctttttctatgtgctatgcttttcatctgccttccatacaacagtgcaagacaaaccccagctccccgaccctgaaattttacaatttctagtttttcacacataaaaggctttacttaatcatataaaaatgtagtccccagctagcaaatgacctccatagggaactttaaagagacaaag

SEQ ID NO: 206773 - DNA, 601 bp, Human
tatagacactgttaatgttgtctttaatcttacaaagaatatatcttggctatgtcttgaaaatggcgccttgtctacaattaccatagttgtgactatgttaaggcacaaggggctcggagtaaaaaaggctggtaggtgaagaaaagacaatgattgtcctctgccaccaagatacaggatacttccccttactgtttcctttaggtacaatacaaacaaaaggctgctgtacatggagagatggggaaatgaaggcacatgagcattagttagctgcaggcacacgatcacacaaackagatacctgtctgggacactgcaagtgctctgctgtggggaggtgaaagtgggcgctggggaagggctgttattcacataggctgtgggggcatcgggccacggagaacactaaggacagaaacagaaataaattagtgatatgcttttaaaatatgtggaagaaatatttttgtaattcactcactaaccaaatgcaagattataaaatgcgagacagctgacatttatcaagcaacctcacagacacatgtcaaatttacttctgtgtggcaaagaaaagttttacctgctgtgtgcg

SEQ ID NO: 206774 - DNA, 601 bp, Human
tctcccggtttttggccttgaacacagttccgtaggtgcctaggggaaggaggtcaggggtcagggtgaggatgcggcactcttccctaagccaggaaatgcctcctgagagaggtgaaggcagcgtctcagtatgcaagggaagggattcagggtgaaggtaggttggtgagctttgtgagtgaggatgtggcaggtggggagggaggagaaggtgcccaccgaggctccaggggctcggcaggaggggcgagtgcggttgccagggcaaggatgtctaaaatgaaggcggtgctccggragggtctggaaatagtgaggaggggtctgggagaggactgaggggctgcagaaatattgaggttggaggtctgcagcaagaaacgaggctgggggtcggggtgaggttgtccaagtgctgctgaggctggggtgagaaatttcaggaagtgtcgcggttgggaggtcgggtctactgggaacgctaaggttggagtgagagccctgcgggaaatgctaacacggggaagactggtgtctgcacggagtgctgagctagggggccagggctgcagccgctgctgagatcggagcctgtagg

SEQ ID NO: 206775 - DNA, 601 bp, Human
ctatttgtcaactcaaatgggaaagaaggtgcctctgcaacaccccagcacatcacctgcaaagatgcagccggctgaccacatgtcgatggacgtggagtacagcttggccccaaagaggacatccggtgggcggtaccacagtgtgaccacctggaggagaccccccccgaaagggacctcccacttagaggactggggaggaggtttgaggaggaggctcagagaggagaggaaaataatgttttgggtcctggggttggagctgagggactccctcccccaatcccatatcccatcktctagctcacctcagctgagtaacagcggacgggaatcccaaaggctcgagccaggccaaaatcagccaatttcagctccccattctgaagggaatgggaaggggacatggagaagggcctttaaaaagccttgggacagcaccaactccatcctcccagtcctcttccctctgtgctccccgtgccctggccccagcctctccattccccaccttcttcccaagaagtaccctgtttattagcaggttctggggcttcaggtccctgtgtagcacattgcggctatgacagaatcccag

SEQ ID NO: 206776 - DNA, 601 bp, Human
cacctcccaactcagtgcggaaaagctacctctagcttctcaccttatttgcccgctcccagaaagctgcttctgggacgcttaatgacttcctcttcccctacaggttcattttaacctgattcctgctaaagggggtgggagaggaggtattaacacaccatgggaataacagttgcctggcagtaaggataaaatttcctttccactttaccctgaatcagttcctacaaagcagcttaaaacttaagagtcagctcaaaacacaaatgttcctgtttattaatttacaaatttgttmtattcattcatttaggtgcgtgcagagaacttcccgcagccatccctacatctcccaagcacactgctagaaagatgggcatcctctatccttctaccagaactcagtaggttcatttctcataccctagatttaagctgcccacggtgttgaacgcagagccaaatatttgcacgccctatagccgacgtcacccactttcccattaacactaaattaaaacgcatccatggatttcctctccattccgaggcaacaggagtgcatggcacattgccctactcccctgaagctcttcgc

SEQ ID NO: 206777 - DNA, 601 bp, Human
acccaagggcctagagattttcccctccccagccttccaaagcctctggcttggactgaaatcccctcctctggatctcacaacctcagcggagcacacttcccaagagaccccattgagccatgccaaaaggaggctcaagaggagtgtttatcaagcagctccaatcagcttcagctcatctgtggtctgagcagagccggagggcaggttaggagtcagtggaggtggtggcaagcaggaacatggtggctaaaagttgggagcagcttgcaggctggcagagggagccaggaaagcagggataggtcccaaaagacaggtggtagtgaatgcccaaactggcgaactcatgattctgtggctgggccctggtagcaagctgtactatataaaggtggaagatgagagaaaggagaggggagggcaggggaggagaacggagggaggtcggatggaaaaggagaaggggtccccagcttgagaaaggctcaactaaaagttgaggttcccaggcagctcacaggcacctcccaactcagtgcggaaaagctacctctagcttctcaccttatttgcccgctcccagaaagctgcttct

SEQ ID NO: 206778 - DNA, 601 bp, Human
aaaaggaaggcacgttgcttcccattggagcgatcaagaaaaggtctcatcaaagtgggggtgttgctggatgatgggcagaatttggacaaatggcaagggggaaggattccaggtacagaaagcagcatctgccaagaaggaaaatgtgactcaggttctataaggataggattttaggaaaccagggggaaaagactggaaaattaggctagaagcaaactgtgtagccccctaaaaacaactgagaactttttacttgagtgagaacagggacctgctgccctaagtttttgagtargggagtgatgtgataaaaaacagtactaaagtcaatggacttaaaagaccattatctaaagtgagaaagtaaaatgagctagaattagagagaccaaaagtgagaatgttatagcaataatctaaaagagaaaagcagcactttggttatggtacgaggactgatgaggtgggaagatgtgaagacgctgctttaacaatggtttctggtgtctcattcagctcccaaatctgcgaaatgagtagtaactaacaaacaacattgtactgtactgaaagtgttatcaatgaagaaaatgcc

SEQ ID NO: 206779 - DNA, 601 bp, Human
ctactttcacttttcttgggcctttagtgccaccatctccgcaccagcaagtctcagcatcattcttcaataaccaattccagtgttcccacatagctcctctctgtgctccccgggcctgtcaatccaattgtattataacattgaccacctgaaataactatgtctctatttccccacaagacagaaagctacaagagagaagaaattgcataccttcttcatcgtggtctcccaagcacataaatgcttcatcattcagtgttcactttaaaaataagtctctgggcagagcccaggwtttattagaaaaggtagaaactgattctatttcagaactaaacccaaatttcccagagattcaggcttaaaagaccaccctcctaaaacaaatggcccataaaagttagcagttaagacatcacacagtcaagaactgaggggctggtttgagaaactccctatgaattggaagttgggagaggttattattcacgctgctattttggaagcgaatctctaacctgggcattaatcataacttgcctgctacaaatttcatactatgttatagcctggcaaaactaaaccttcttctgtt

SEQ ID NO: 206780 - DNA, 601 bp, Human
actagtggttttgaatcgggatagagccgtctccccagaaaaaggacactcacacagatttttgtctccaatttcaaaacattcttagagaagcccacacatcctctactttcacttttcttgggcctttagtgccaccatctccgcaccagcaagtctcagcatcattcttcaataaccaattccagtgttcccacatagctcctctctgtgctccccgggcctgtcaatccaattgtattataacattgaccacctgaaataactatgtctctatttccccacaagacagaaagctacragagagaagaaattgcataccttcttcatcgtggtctcccaagcacataaatgcttcatcattcagtgttcactttaaaaataagtctctgggcagagcccaggttttattagaaaaggtagaaactgattctatttcagaactaaacccaaatttcccagagattcaggcttaaaagaccaccctcctaaaacaaatggcccataaaagttagcagttaagacatcacacagtcaagaactgaggggctggtttgagaaactccctatgaattggaagttgggagaggttattattcac

SEQ ID NO: 206781 - DNA, 601 bp, Human
gaagtcaggctccctgctagaccatgagaatacaaaaatgaacaagatcccacaacctactcacgtggctgggggcatcagctccgtgaataggtaatggtgcaacacaatgaccctactccttggaaagctgaattaaaatctaagtggaaacaaaatttcagtgttggggattgaaaggaattggagccttgatctgactaacactgagtcagtaccaacatgtctgtcagagttcctataaggaattgccactttgtgggcagaatctcaggaggtggaggatgtagccgctccaccrcttcctcaccactccacaatgggcctgccaaaccttggcttaattctcaccctgtggccctaatttaaccgtgtttgcgaacaatcttggatcactgggattggcagggtcattcagctcagccacccacacaataagcggcaggcgagcgtcatccattagcagatcatggggtgtaatcagcattgaggagattctcattaagtactactggatgtacattgcaaacagctagtgatagcaggggaaatgagctgctagtacatgtgactacactacaggtcactgtaagagtgggac

SEQ ID NO: 206782 - DNA, 601 bp, Human
tctccaagtcttgaatccttggactcaaggcctcaagtccttgagtcttgggcctgcctctatccttttcttgcccaaagtctgtctcctgaccaagccctgtgtccacagatctacatgtggccagatgggggcctctttttctaattcacccaaaggtgctttatgcaccagtggtggccctgcagccagcattgagaggtggccaggcaccattggctgactctggctagtatcctgccacagttgaaccttgaaagcactatactaagtgaaagaagccaaacacaaaatgataaattactgtgtaattccatttttatggaaggtcaattgtaggcaaatctatagaggcagaaaatagattagtggttgcctagggatgggggattaagaaatgatggctaaggtttggagtttatttggggggcaatgaaaacattctaaaattggttgtggtgatgaatgcacaactctgtgaatattctaagaccattgaattgtacagtttaaatgaatgaggtatggtacatgaattgtatctcaataaaactgttatgaatttaatcacaaatcagttggggagctcaaagcaaatggt

SEQ ID NO: 206783 - DNA, 601 bp, Human
tagctgcaggaaaaagccatgcaaggcccctgttaccaatcagcctgaagatgtgctttgctgctgctcaaggctaagccaggcaggggctgtattcctggcagaaaggcttaaaaggagatgaagccaagggaggttgcatttgtttttgagttagagaagggaggaaaaacctaacctacaggctgtacatgcttatctcaggaatgctggggacttaggaaaggaaggtcagaggattcagtgatgaaggcaaagccaacaggaaaagggagaggaggggaagtgaaccattgtgtgkcagttataaacaggcaagccactctgtcttggccaagggctgaactcattcatcagaccagtacttcctaaatttcatcatgtagaagaatcattggaaggatcttgttaaaatgaagatgctgattcagtaggtcttgggtttgggcccgagcttctgcaattttaacgtgctcccaggtgacccaagagttcaccacagatgctgctggcatgcaagcacagctttctgtgttgttattttacagagtcacaagctctaaaagaatatggggtccatagcttgtccacttggagttaa

SEQ ID NO: 206784 - DNA, 601 bp, Human
tgagccgagatcatgtcactgcattccagcctgggtgacagagcaagactcggtcaaaaaaaaaagaggaaaagaacagagaaaaaaaataccattgctgggttggaaactactacttacccaactccctgaaaaggtgagagaccctctttaagtgctgttaacagttcagtcttcctgacatccccaattcatggagcttgaggggcttaatgtgaggggctgtgtgttttcctgactaacccactggtctcactctcactcatctcccaaggtgctgcctccccgctaaccccagtgkcattgatttctggtatgaagataagaagtccctgtgtctttaagagctgatcagttccaggaattctcagccccaggagtcttgccggagtggcaggagcggccctgatcacactagcctggttttcttgacagctaaagttattcatcaggtattaatacatcttagctgcaggaaaaagccatgcaaggcccctgttaccaatcagcctgaagatgtgctttgctgctgctcaaggctaagccaggcaggggctgtattcctggcagaaaggcttaaaaggagatgaagccaagggag

SEQ ID NO: 206785 - DNA, 601 bp, Human
gcaggagaatctcttgaaccttggaggtggaggttgcagtgagccgagatcatgtcactgcattccagcctgggtgacagagcaagactcggtcaaaaaaaaaagaggaaaagaacagagaaaaaaaataccattgctgggttggaaactactacttacccaactccctgaaaaggtgagagaccctctttaagtgctgttaacagttcagtcttcctgacatccccaattcatggagcttgaggggcttaatgtgaggggctgtgtgttttcctgactaacccactggtctcactctcastcatctcccaaggtgctgcctccccgctaaccccagtggcattgatttctggtatgaagataagaagtccctgtgtctttaagagctgatcagttccaggaattctcagccccaggagtcttgccggagtggcaggagcggccctgatcacactagcctggttttcttgacagctaaagttattcatcaggtattaatacatcttagctgcaggaaaaagccatgcaaggcccctgttaccaatcagcctgaagatgtgctttgctgctgctcaaggctaagccaggcaggggctgtatt

SEQ ID NO: 206786 - DNA, 601 bp, Human
accaagacacaattgctagagagacagatgtgggacagatgatgctacccaaaggttggggttttttttcttccccacttccacctccccaagcctgcagtggtcactgccaccagtaaatgcttcaggaaaaattcaatgtcatgttcccaaatgtcttgtcctgaaaccaaaaacacagtgttcactgaaatcaacaaatgtgaaacactaggctagtgagatgttcggagaaaaccatttggaaacgtccacaccagtggttctcacacttgagtgtacataagaatcatttggaggrtctgctaaaatacagatggctaggcccacttcccacatacccagcttgtgattcagtagctctggggtgtggtctgagaatgtatatatctactaggttcccaggagatgctgctgctgttgctgctggtctacagaccccactttgagattctgtggtcctcactattcctccttgtcctctctcagagagtaacaaggtatactggcatatcaatgaccctgagcagtcctgcaataaagaaacctatttaacccagccttttgcaactaaattacagtgcatcctgcttcccatata

SEQ ID NO: 206787 - DNA, 601 bp, Human
ggcggaggccacatggcctcagagagctatgagcatgggagggatacactgagctggagaagagctctctcttgcatcaagttcacatttgagggttatcaaattgcctctgttccctggcaaaggagatgattccactcctttacaatttggttcagaaggcaaaaacaaatcaagaacccatccatccacatcagctcttgaggcttcaactccatttaaacaaagacagagtaaagatccaggcaagactatttcaaaggcctaccccatgttctgaacacctgcccaatagaacagyctgcaaacttttaaaacagtgtttttcaatgtgggcgctatgggcattctaagggagccaattctttattgtgtaggcctggccttctctatcattatgacaacccaaatcactaccatatatttccaaagttcccataggcaatggcatggaaatttaacaaagacatcttaaatccatttatgccccgcccacacatacatttgtgggtatttttttctttataattgaggtaaacatatatagtaaagtgcacaaatcttaagtgtatacagctcaatacattctatgtatgtgcat

SEQ ID NO: 206788 - DNA, 601 bp, Human
gcaggcttgggaaagagcagccagctagttgcccacattgtgagccagcaggtgaaatagtttcttaaaaaagagagagcaacagtggcctgcaagaggacagaggctaaaccaaagaagtctggcttatcctagactgaagcaaccacactggaataacagaccatttgggccaattctttttttttcctttcttttttttggacatgttataattgtacatatttatggaatacagagtgatattttgatatatgcatacaatgcataatgattaaattggggtaatttacatatctaycacctcaaatatttatcacttggggccacactttgagaaggacacagacatgccagaagatgctagaaagaaaaaacaaaaaatgaccaacagagactagctttcatagcaaataaataagtaaacaaataaataaaaagtttgttgaatggtgaataaactttagatttgtagcctgaagaaaatgggactaaaaggaaatagaatccctgtgttctgatttctcaatggtcatcccatggataaaaatagagagaaacttactttgtgcagtaccaaaagtgagaaataaggacaatg

SEQ ID NO: 206789 - DNA, 601 bp, Human
agcaactcttaagaatctaatgttaagtgaagaaaagcaagcaagttatagaagactatattcagcatgtgtccatttatacacaagtcaaaagcatgcaaatgtaaataatgttttttgtttgtttgtttttggtttttttttttttttttttttttttttgagatacagtcttgctctgtcacccaggctggagtgcagtggcgcgatcttggctcactgcaacatccacttcctcggttcaagcaattctcctgcctcagcctcccaagtagctaggattacaggcacgtgccaccaygcccagctaatttttgtatttttagtagagatggagtttcaccatgttgaccaggctgttcttgaactcctgacttcaggtgatctgcctgcctcggcctcccaaagtgctggggttacaggcatgagccactttacccggctgtaaataatgtatttttagagatataaacatattctataaagaaaataataggaatgataaatacaaaatttaggacattggttacctctgaggagatagcgaaaggaaaagaatccaaaggaaagaatagcaaggactacagggtaaagtttttgc

SEQ ID NO: 206790 - DNA, 601 bp, Human
acagcctatactctcagtgtaaagagtgaaataaatccatcccatgtatagggactacaaagaaaagttctcatcttgtaccccagcagtgagtgaaagaaggaaaatccttcccctgagaattaataaccatattattattactattatattattactaaaataccactaacaataattaaaaccacagtcataccatttctgacccattagtttggaagaactctaaaaatataacaagatcaagtgttaacaaggatgttgagcaatggaaatacacattggtgctagaagtttagaytggtataacttccttagtaaataatttggcattattgaacaaagtcaaagatatgtatgcatattatccagcaattcaactcctaggtacttagtctagagaaattcctgcacattgttcaagggagatagacaagaatcttcccaatagcactgtttacaagaacataaaactagcaacaacccaaaatgcacatcaagagtagcatggataaatgatggcatatttacacaatgggatcttacaagataacgtgaatgaaaaaatcacaactgcatgtaacaacatgagcaactctta

SEQ ID NO: 206791 - DNA, 601 bp, Human
ttggtgggaaataatcactgggtgccagagggtagactctgatatgcagcttctaagatggcccccaattatccctgtcccctggcattcataaccttttgtaactcctcactttaagtgtggaatgaatttattaacttgcttctaatgaataaattttggcagaagggacaccatatctcttttgaagtcaagttataaaaagactgtggtgtccatcttgaatactgtctcacactctctctcttggatcactcattccgggtcaagttagctgccaagtcatgagggcgccctgtgragtggcccatgtgttgagggaccaaaagcctgccaacaataacataagtaaggttataagaagatctccccagctacacacacacataacacccacaagtcgagccatcagatgaaactgcaggccaagccaataacttgcttgcaacctcatgagagaccttgagccagctaaaccatgcccagatcctgacttataaaaattctaacataataaacagtatttgtttttaaaacaaaaggaggaaaaggtgtaggaagagtagaaagtacaaaaggaggaagggaaaaagaaagggca

SEQ ID NO: 206792 - DNA, 601 bp, Human
attaagggtatctcaagttcctctcaatcaaacagagaagagtctatatctatgagatttgtaaggtggctaatagggtgaacttttgtctaatagagtgaattctaagaagattcacaggagacccacaaaattcttaaaagagttatatatgctgaaatatcactagcttgacttaggaaggcagagacattaaggaataaggagaggtctttgatcccctacaattatactgtcagaaagcaggctcagtgagctgcttagctgtgaatagatgctatttttctaaaaaaaaaaaaarggggggggggagtgagtatattttgcatgttggtgggaaataatcactgggtgccagagggtagactctgatatgcagcttctaagatggcccccaattatccctgtcccctggcattcataaccttttgtaactcctcactttaagtgtggaatgaatttattaacttgcttctaatgaataaattttggcagaagggacaccatatctcttttgaagtcaagttataaaaagactgtggtgtccatcttgaatactgtctcacactctctctcttggatcactcattccgggtcaagt

SEQ ID NO: 206793 - DNA, 601 bp, Human
tgccttaaatttcttgtgacacataaattatgtcctcatgcttataattttggatggttttattctaatcagtccagcttccgtatataaatttaaactgtgacaatactgcagatttggatgtttacaaaagggtattttgtactattggaagccatagggtgtttatttgtgggagccagatgatttagtgctaacaaatgatctgccaatggattacagagcagctgtggtacagtatgaaggacatttgaatagcttctgaacaaagatcaaatccaaggcattgccagaaaaacaygatttaaagatgaaggcaaaattacggctgtaaaatcctttgttaaatcaaggtagtgccttaaagtaccttcagtcttacaaaaggccccttagagagattaagggtatctcaagttcctctcaatcaaacagagaagagtctatatctatgagatttgtaaggtggctaatagggtgaacttttgtctaatagagtgaattctaagaagattcacaggagacccacaaaattcttaaaagagttatatatgctgaaatatcactagcttgacttaggaaggcagagacattaaggaat

SEQ ID NO: 206794 - DNA, 601 bp, Human
gggttgaaaagtacagtttctagattcccttatccctaggttgtgaaagggtctacttttagtgatttggaaggaatcaaagggaaggaactcttttctacagttgtgcatgcagaaaataggctacagcagatgtgagtgttgtcaactgtgtccactgtcccctcatcagctttgtgtggtagggaggatagtgacgttggcagtggtgataatcacggcagcaacagtttcctagcctgagtgataggaggagtttctggcatctggactgaagtcatggtgccatttgacctttaakgcagacttcttgacttccattgctccagcccttccaattttgtgagtaccttatttcctgcattaaatcattttttgcataaaatacctagagaggattctgtttcctatattaaacctaacagatatttaagcaaaccaattaagaaatgaatatatggttttatagctttctcttagtaactggacactaccctaacacagggcacactgctttctacccacaagtcttttgtagataagagaggggacttttatgtgaacatagatgagtaaggaggaaaaaagaaaaaaaaaacct

SEQ ID NO: 206795 - DNA, 601 bp, Human
ctgccatttggacataagtatttcccaggagtccagtattggtcctttacatatctccagactattttcctgggccatctcactcccatacttgcctcaaaccattccccatgtactgatgataaatccattgtttctagccttgaactgtctcctaagagccaagctagaatcttcaactgttgtctggatatctccacactcacactcaacctgctcaaaaccagattccttttcttatcaccaaatttgtgcatcccccagtgtttcccatttcagcaaataaccatcttccagctastctgccacatggaaaatctcagcctttttttcttctatcttcttcatctaccacattctaagataggaattaacttaaatatccaactacaagaaatggtcaatcatattatgatccattcataacataataatgttcattttgaagaggtttcttaacatgggaaaatattatagaatgctgaatgaataaagaaagaagcataacccccaaaatgcaaaaatgcattaagattttaaaatatggcaaagctcatgtgtgagaacaacaatatggatgaataaaactaaaataatattg

SEQ ID NO: 206796 - DNA, 601 bp, Human
ttcacttgtgtagaaaacaactgaaggacatctccagtcaaaagttgtccagtcctaccctgattctcctgtatctgagacacatcacaacaaacaagggccatgtcctcatcccaggaattaggacaaatttccagggcaaaatgccgcagtgaaactttgttaaccattttttttttttttcaaattcttcctccactgtaagaggaactagattcagagagaaagcatctctaaatttaccttcatttctcccaggtttccctaagcttcagagaaatgtttcaccagtagaaatatytgtggacatacttacctgagtctggacagaaggttcttgtttaggctttttatacgtgctggggagtggattgctgggaatatgtagagatggagttctttatcattaagtttcatttgagcaacatactttaacataccgtttcagaagccatgctgggctcagaaagagcacgatgaaatgagcttatgaaaatcaagttttctccttccccattcatcttagtacattatcagcacttggtccagatttgaccttaggtggtttactctggatgattctggctgtaatgtatgaatt

SEQ ID NO: 206797 - DNA, 601 bp, Human
gaggctatggagatagaaactataggtaggaatgagtatttgcattcagatctcacaaaaaaatgtggtatgtgatgggaagcacacctgcacataagcaccaggcaccagtcattatattggaaatattgttcacttgtgtagaaaacaactgaaggacatctccagtcaaaagttgtccagtcctaccctgattctcctgtatctgagacacatcacaacaaacaagggccatgtcctcatcccaggaattaggacaaatttccagggcaaaatgccgcagtgaaactttgttaaccattttttttttttttcaaattcttcctccactgtaagaggaactagattcagagagaaagcatctctaaatttaccttcatttctcccaggtttccctaagcttcagagaaatgtttcaccagtagaaatatttgtggacatacttacctgagtctggacagaaggttcttgtttaggctttttatacgtgctggggagtggattgctgggaatatgtagagatggagttctttatcattaagtttcatttgagcaacatactttaacataccgtttcagaagccatgctgggctcagaaag

SEQ ID NO: 206798 - DNA, 601 bp, Human
ctgtgcctgacccctaaagtttctgactcagcaggtggtgggggtgggttggtaaaaatttgcattcttagaccaggagatgctactgctgcttctgctcccaggaccacaccatgggaaccactcactgcccaacaaacccagagtaaggcaaaatatccaaatcccttccagctgaacaaattgagtgcttgctgaccaccagagtcaatgacaaagaagctacattggggctgaaagacacatagatgttctctactggactgtccctatagtgtcaataactttgctcaggcccccraactaaaatcagcaggagtatgccacatctctgccagcctgtagttgcctcaatagcaaaccaagaaaaagacaaaagtcagatggaagccatcagctacgaagtcagctccaggatagacactgaggttagatctagggctgagccagagaaccagtgatgctactgagagcaaagttgcatgcttaggccttacaggaggaatagtgatgctccctttacaatccacgatgtgaacaccccctgctcctcccaaagcaagtgcctcctaagggctgtggcattttcttacccacacag

SEQ ID NO: 206799 - DNA, 601 bp, Human
caaaaaacaaggggtgaaaaagttttgcactaaactgtactcacagagcacaagagcggcagcctttggcaccacctgggagacacagatggcttcccagtgcaggtaatggcctgggggcatgagtagggtctgcctgggcaggcaatgggggtggctctattcttaaattaaccaactggcttcctctttccccttctgttcctccttcccttcttctcaccaccccttcttttacattttttttatttttaatttttgtgagtatatggtaggtatatatatttatggggtacatgaatttttttttttaatttttttgagatggcgtctcactctgtcacccaggctggagcacagtggtgcaatcttggctcactgcaacctcagcctcacaggttcaagcgattctcatgcctcagcctcctgagtagctgggattacaggtgtgtgccaccatgcccggctaatttttgtatttttagtagagatggggtttcaccatgttagccaggctggtctcaaacttctgacctcaagtgatccgcctgcctcgtcctcacaaagtgctgggattacaggcatgagccaccgcacccag

SEQ ID NO: 206800 - DNA, 601 bp, Human
ctcaggagactgagtcaggagaatcacttgaacctgggaggcggaggttgctgtgagccaagatcgtgccactgcactccagcctgggcaacagagtgagaatctgtctcaaaaaataaaaaaatcaaataaaatgtaacactcctaaccatattacgcaagttacccataaaaagaacaaggtgaatattctcacaaagcttgtagacaaatagagtcatctgatggcttgatgttttgtgtttatcacacaggttttttcaacagcagtcagagctgcaaaaatctaaaaacctactaygtgctggggctgggccagacattgtgctagaccctgaagagtcaaaggtaaataaaacccaatccctgataacatcaacttacttttcaattctgattgcctacattttctccaaaggaatttgtgggatgtgtatgtgacagcaaataattttttaatggtcaaactttatctttgagaagttacaatgggagagcataactagtaatactacttaagctagatgaggcactgggggaagattattggaatgtaggaacaaaatgtcctgtctcctctcactagaaactgtactgttat

SEQ ID NO: 206801 - DNA, 601 bp, Human
ttgaagaatagaatctcctaagctttagtctgttttagaagagcagtttgtgaccagaaaatggaagacccaaactactgggaagcttagacttttttcttgctgaagggtagaatggtagggaagtgggtagaggggggagggaggatgaaaaatatagggcccaagtctcctccttcaatctcactcttgttccaggggggacctgaattgcctcactgttgggaagacgagggaattttctgtgaggaaaatcattagagaatatagtccaagcagtcactggcaatttgggcctgcrgggcgggggtgggtgctagaactttctctgttctttctgtctgggacagtggagacctaaaggcaagttctctgtgattccttggttatcctaataacataataataatgacaaaaagtgttctttgcacttacataaaccttacatgttaggcatggttctaggcattttgcatatatttacttaatcctccttatttaatccaacaaccctataaggtaggtagtattatctctgattcacagatgaggaaactgaggcacaaaaaggctaaagaacttgcccaaggtcacacagcta

SEQ ID NO: 206802 - DNA, 601 bp, Human
tgtgaaatgagtgagggaggagggatgactatttggtcagtgagtgagtcttgcaatggtcaccatccataccaatgagaccactgatatcaactggtttcgcccctagtgttatagatgaggaagtgaagtccagaagagtaaggagtaaagatggttagcaattagttgcccaaaccatcaggcataaaataatccttaaaaacattttctttcataccaatggtactagaacactaaaaacatgttctcctggtggcccaaattagggggctcctattcaccctggttgtagatggaytcacaggcttcagctggccacctaagctcagggatggaaaaattattgaataatattcttctaggacagtcagctatgggatcctgtaagactagtcctgggaactccttaaataatctggcaacactgacgcccatccggatgtgtatcgtgaaattcaggcattaagatagggcacttccccaagccttattagagactaatctaaagctggcaagtctcccaccacagtaggcacttgagagagttctggcttgaggacctacttccctttgctcttctaaagagagggggaaacaa

SEQ ID NO: 206803 - DNA, 601 bp, Human
atcaggcttctacatcagcctgtgaaatgagtgagggaggagggatgactatttggtcagtgagtgagtcttgcaatggtcaccatccataccaatgagaccactgatatcaactggtttcgcccctagtgttatagatgaggaagtgaagtccagaagagtaaggagtaaagatggttagcaattagttgcccaaaccatcaggcataaaataatccttaaaaacattttctttcataccaatggtactagaacactaaaaacatgttctcctggtggcccaaattagggggctcctatycaccctggttgtagatggattcacaggcttcagctggccacctaagctcagggatggaaaaattattgaataatattcttctaggacagtcagctatgggatcctgtaagactagtcctgggaactccttaaataatctggcaacactgacgcccatccggatgtgtatcgtgaaattcaggcattaagatagggcacttccccaagccttattagagactaatctaaagctggcaagtctcccaccacagtaggcacttgagagagttctggcttgaggacctacttccctttgctctt

SEQ ID NO: 206804 - DNA, 601 bp, Human
ggttgcctcatttagtagctacaaaatttacatagctgagaaggacacatttcccagaaaagtgaccctcaaactttagagtgcttaggaatcacctggagattttgttaaaagtgtagattctgacacagtaggtctgggaggggccctgagaattggcatgtctatcaagctcccaggtgatgctgatgcttctggtccggtccatggatcacacgttgagaaccacttttctaagaaaaaatggctgtcaccctctgagtcaaagaaattccctggggaaaaatgtgggcaggcaacyaattgattgcttccagccaggcatatcctggacaggtttggcaaagacaattgttctgtggctaggcctggacagcatgtcaattagacttattggtgaagacagacaaacctcattagttggaaaacgattgggttaactctaaggagtcaatgttaatcaggttatggcccagaaccagaaatgaatggtggtagctctaaagtgccacttcctgaaactcactgtaagtgcattaggcactgaatctggcctttgcttttagtgaaatggctgggcccttcctgttaaaggtctccc

SEQ ID NO: 206805 - DNA, 601 bp, Human
tctaagcacttagttctatccactgtaataaatgaataaaatagtctcaaaaaaatgtgcagcactgtatccatggcacagcatacatcctgcctctttagtattcagtgaagttggccactcttttgcaaaccagcctcaggacaaaagcaagcaatttctagtttgatccttacagtttctagtcagccttccccacacacccaagatgttggttgcctcatttagtagctacaaaatttacatagctgagaaggacacatttcccagaaaagtgaccctcaaactttagagtgcttakgaatcacctggagattttgttaaaagtgtagattctgacacagtaggtctgggaggggccctgagaattggcatgtctatcaagctcccaggtgatgctgatgcttctggtccggtccatggatcacacgttgagaaccacttttctaagaaaaaatggctgtcaccctctgagtcaaagaaattccctggggaaaaatgtgggcaggcaaccaattgattgcttccagccaggcatatcctggacaggtttggcaaagacaattgttctgtggctaggcctggacagcatgtcaattag

SEQ ID NO: 206806 - DNA, 601 bp, Human
aagtaaattgtagcctttgattaaatcaatactgttctaagcacttagttctatccactgtaataaatgaataaaatagtctcaaaaaaatgtgcagcactgtatccatggcacagcatacatcctgcctctttagtattcagtgaagttggccactcttttgcaaaccagcctcaggacaaaagcaagcaatttctagtttgatccttacagtttctagtcagccttccccacacacccaagatgttggttgcctcatttagtagctacaaaatttacatagctgagaaggacacatttyccagaaaagtgaccctcaaactttagagtgcttaggaatcacctggagattttgttaaaagtgtagattctgacacagtaggtctgggaggggccctgagaattggcatgtctatcaagctcccaggtgatgctgatgcttctggtccggtccatggatcacacgttgagaaccacttttctaagaaaaaatggctgtcaccctctgagtcaaagaaattccctggggaaaaatgtgggcaggcaaccaattgattgcttccagccaggcatatcctggacaggtttggcaaagacaatt

SEQ ID NO: 206807 - DNA, 601 bp, Human
tgcagagacagacttgagcagttgcaacagagaccatggcgtgtgaatcataaaatatttacttttttataaatacttcacagaaaatttgctgtcccttggtgtagatgatactgaaaaactaccttgagtattcagttttgataaaagtatctaatttctggctttatttagacctctcaagcaacaaacaaataaaaaaccaaaaaataagaacagattttgagtaattagatgagtcttgcagaattccaagaatagtagtttgtttcttatcagttttcctaaccaacagtggcargaggtcttggggccttttacaaatgtattaaacacctatgactacatgtaaaactctatgctaatacaaatgtatcacctgggaaaaaacagtggcttacaagaggttccgcctgagctttaggaccttctttcatttccatcaactgatcatggaagttttactttgtctacaattctgcagaaagcttccagtttcatatagccccttccttcgcatcaagaaaattactttctcctctgaaccctcatttcgttcattcagttcttagcatatgctggtatttaatttgtatgtttt

SEQ ID NO: 206808 - DNA, 601 bp, Human
cccagcactttgggggaggctgaggtgggaggattgcctgagtccaggagtttgagaccagcctgggcaatatagtgagactttatctctacaaaaaatttaaaagttagccaaccatggtggtgcatgcctgtagtcccagctactctggaggctgaggtaggaggatctcttgagtctgagagtcagaggttaacaatgaaacaagatcgtgccactgcactttggcctgggtgacagagcaagaccctgtctcaaaagaaaaagcactgatttaaagtacttggcatagtggttaacrtgtcataagcaatacaggccacaatgattttgttgtttgaaaaagccacatgagccaggcatggtggtgcagcctgtagtcccagctacttgggaggaagaggcgggaggatcgcttgaggccaggagttccaggccagcctgagcaacatagtaagacacacacacaaagccacatgatttcttcatgttgcatatgtgaaaaaaatctaaaataaaaagaacttttacagtccctagtcacaagtgtgtgaggtgaccaagatgtcactggtttcagtaacaacccctagctccttaa

SEQ ID NO: 206809 - DNA, 601 bp, Human
tactgtacttactgtgtcaggtatataacacagccttatgtcatccaaaatcctatattagtcaaggacttcaaacttccctaaaggtaaaactcttgttggggctgtgtataagcccctatccccacaaccccagagaatttaagggacattattgagcccaagatggctttagataagttttttactttttacatgatcgaggttggcctaacttcttagagttgttgctcagaagaagaaagcaaacactgatcgcaactgtcccttctcttggattggtagggtttttttttttttwaattataacacaaggcttctggaccagtgctgtccaatatggcagctattagccacatgtggttattgagcctttagtcagagctagtccaaactgagatgtgctgtaagtataaagttgatgttgaaattcaacgaagtaatgccccccccaaaagtaaagtatctcaccaatagtgtatgttgattacatgttgaaatatcttggatattttggggcataagtatacgaaaattaatatttaaaatttggctgttagaaaatttaaagttatatatgtggcttacatttgtggctcac

SEQ ID NO: 206810 - DNA, 601 bp, Human
gagatgtgctgtaagtataaagttgatgttgaaattcaacgaagtaatgccccccccaaaagtaaagtatctcaccaatagtgtatgttgattacatgttgaaatatcttggatattttggggcataagtatacgaaaattaatatttaaaatttggctgttagaaaatttaaagttatatatgtggcttacatttgtggctcacattatatttctattggacaacactgttctaagcaggggtcagcgaactttttgtaaagtgcttggtagtaagtattttaggctttttgggccacasagggtctctgtcgcatatttttggtttttattgtctttttataatcccttaaaaatgtgaaaactattcttagctcacaagttgtgtgaaaacagtctgtagttcggatttggcctgtggcccatagtttaccagaccctaatctcagtagaccggttaggtctgtgacctttaatattctgaagaataaacataaagctttaagattataaacatttgggaagtcagcatcttaatttcctctagaaaatactttgtgttattttcttacacattataaattgttcttcaaaattgagt

SEQ ID NO: 206811 - DNA, 601 bp, Human
aaagagaacaaatgaaccatcattaagactgtcagcaattaaacagatacgtgactgtctttttaagatattaaatgattgttattttcaaagaataggcatgctgatttaagatctctataatgtataagtaaattgcattctaattatatgcaaagtgtttccctttccttttcatggccttcagagcctaaccaataatatccttttaattaaagatataagacctttctgaatggtcactgtgatttcttaatgtgaagaataatgtgctgagttgtactcctttaaaactcatgtrtagacctataccttatcattttatgtctccaaagtttggaagggggctttacattggctcacttttatttcacatttttacatttatagttcccatttccatgagtcatggatgttgtttttaatcatgttcttattaatggagtagactaaggattagtaacagattgggtttttttttcttgtctctttgtgtcctctactaggctgggtcactgggaagatttagaagtcatttgtagagaacaataatctctcctatggccatagctcttttttagagattaaaaagatttagcag

SEQ ID NO: 206812 - DNA, 601 bp, Human
ataatgaacattataaacatatccatttcctttgactctttacctccacatctgggactctagcttaaggaaacactttcaaatatagaaaaaatagtattcattaagctctttagcctaacattatttattattatgaagaattaaaagcaaccaaaatatctaattgaggaatggttaaattattggattgtcattcaattagatattatgcacacattaaaaatgattataactagtttcggccgggctcagtggctcacgcctgtagtcccagcactttgggaggccgaggtgggtrgatcacctgaggtcaggagttcgagaccagcctgggcaacatggtgaaaccccgtccctactaaaaatacaaaattagccgggtgtagtggcgtgtgcctgtagtcccagctatttgggaggctgaagcaggagaactgcctgaacctgggaggcggaggttgtagtgagccaagatcacaccattgcactccagcctgggcaacaagagtgaaatcccagcactttgggaggccagggtgggtggatcacgaggtcaggagatcgagaccatcctggctaacatggtgaaaccctgtct

SEQ ID NO: 206813 - DNA, 601 bp, Human
aaaataaattccagttgaattaaaattaaaacttgaaaccataaaaggccttgaaagaaaagacccatgttatcatttttatgagcacagaatgaggaagacatagagcgaatagtagaaaccatgaatattttttatgtaacagtaacacctttattttttattttttaaatactttattagagcagttttagattcacagcaaaattaagaaggtacggagatttccccccttacaatgatgaaccgacgtgaatatgtcattaccacccatagtttacattagggttcactcttggtrttgtaggaaaccatgaatactaatagatttgactacctaaattttatatatcaaaaactaaaaacaaagtaaaattaaaaggcaaacaaactgtggaatacatttatgtcatgtattacaaaggaccaatgctgatatttgaagtgatcttacggatcagtaagaaaaagttgaatactttaggagaaaacaagtcaggttatcagtaggcaactcgcagaaggaccaaaaaatggtcaaaagtacggggaaagttcagctttacaaatggtcaaagaaatgtaaatcacattgcagatt

SEQ ID NO: 206814 - DNA, 601 bp, Human
cctttttctttgtactacatgcaaaaaaaagcttttcatttaggaggatttattactaaaatctgctatatttgatacttcactatttttctttctgcggctattgcctagtgcatagccatcatttgttactttgaggaagcttctttttttatagagaagattaatatgttgatgaatatgctccattaaccatgggcatatctgtaatcagggtctttctatcctttgccttttccagtgtggttatcctcatgatgcctcaaagttttttaccaagtcctaaaagccaatctttctrttcatcgagtcagaatgataaccactgtactcaaaacccactcaccttagaacttgatttgacttatcagctgaaataatttcctgcttctgcttatgtcctctgctggctagagcaagaaaactgaaagcactgggtttaacaaatatcatagtctatctagaaacccaagtggaagataagaagacacctgggactagctttgagtatcactccctgttcttggtcttggcttcccaaatgtatcattgtaactatacctaagcatttagaagcctataacacatataaaatcatgat

SEQ ID NO: 206815 - DNA, 601 bp, Human
gaacttgatttgacttatcagctgaaataatttcctgcttctgcttatgtcctctgctggctagagcaagaaaactgaaagcactgggtttaacaaatatcatagtctatctagaaacccaagtggaagataagaagacacctgggactagctttgagtatcactccctgttcttggtcttggcttcccaaatgtatcattgtaactatacctaagcatttagaagcctataacacatataaaatcatgatggggagagggccacgtcataactcccctgctacctccactgataattacrgccataattagcaagcatgctaataggaatgtgttttatcctttcggtgtgtggaccagagaaaaggttaaaaacctctgttttggcagagaagatgtaatcacttcttattactttccagttgtttatgaacaagagtctatttattggcaataaatcctcatcttgacagagcatatactgttacacagatgtgcacaatagtggcttaaagtggtggctgctgggttttttttttcttttaaaatcgccttcagtgctttgcagcctttaggattttacctatagacacatcgttaa

SEQ ID NO: 206816 - DNA, 601 bp, Human
tatgtcctctgctggctagagcaagaaaactgaaagcactgggtttaacaaatatcatagtctatctagaaacccaagtggaagataagaagacacctgggactagctttgagtatcactccctgttcttggtcttggcttcccaaatgtatcattgtaactatacctaagcatttagaagcctataacacatataaaatcatgatggggagagggccacgtcataactcccctgctacctccactgataattacggccataattagcaagcatgctaataggaatgtgttttatcctttyggtgtgtggaccagagaaaaggttaaaaacctctgttttggcagagaagatgtaatcacttcttattactttccagttgtttatgaacaagagtctatttattggcaataaatcctcatcttgacagagcatatactgttacacagatgtgcacaatagtggcttaaagtggtggctgctgggttttttttttcttttaaaatcgccttcagtgctttgcagcctttaggattttacctatagacacatcgttaataacagcttaacaatttacagtatgtttgtaaaaataacttgggt

SEQ ID NO: 206817 - DNA, 601 bp, Human
aaatgtcgtattagtgcaattaaataagagaaaaaagcataaaaggagtaggcttttttggcagatactgttatatgggatggacaggaggggaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctytcctcagtctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttcccacggtcttcccgttgccgctaacctaactaactctcagccatggcctccaacgaagatttctccatcacacaagacctggagatcccggcagatattgtggagctccacgacatcaatgtggagccccttcctatggaggacat

SEQ ID NO: 206818 - DNA, 601 bp, Human
agtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctttcctcagtctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttyccacggtcttcccgttgccgctaacctaactaactctcagccatggcctccaacgaagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaa

SEQ ID NO: 206819 - DNA, 601 bp, Human
ctcacgcctgtaatcccagcactttgggaggcggaggtgggaggatggcttgagctcaggagttcaagaccagcctgagcaaaatggtgaaacccctgtctctagaaaaaaaaacacacacactaaaaaactagccgagcatgctggcacgcgcctgtagtcccagctacttaggacactgagtcaggagtgttgcttgagcccaggaggcggaggtttcagtgagccgagatcacgccgttgcactccagcctgggcgacagtgagactgtctcaaaaaaaaaaaaaaaaaattaaattwaaaaaaaaattaaaaactataaaactgtcttgaaaaagttattagaaaacttgctgctttgtactcttgagtaaattattaaaattattacacatgtatactcatatacatgctgatgtgggcagagaaaatctggagtaatggaaaatgataacagtatgcttactgtgagtcatggggctggtggttgagaaatggtatttgggaaagatgactttttattacttctatattgtttggaatttttatagtcagtgtgtattttttagtaattttttaaaagccaattgaacattttta

SEQ ID NO: 206820 - DNA, 601 bp, Human
acggggctatttctttaaaaaaaaaaaaatgaaatatatactgattttgaaaagaaaaagccactaaacatctgtctgaaatttggtggggaaaaaagagagatgagatgagatacttcctgagcacactgtaaatgaagatgtttaaattttgaattatggtgtatagaatttttagaagagggattaaacaatacctgctatctggttccaagtgaagagtagattgctttaaaaaaattctctatgctttgttgctaaaaattcctttataaatagtggaagtaaaatttgaccattytgtttctatacttaaatgtttttaaatccttcttaaatattgaaaaccctgttcttatttgtataagccagttgtaagtttatttgagggcaaagtaaaaaacattggtgataaaagtgatgttgtgattatagtaagctggaatttaaacttagaacacagtgtaagccttgccaaattgatagtttacattctttcagctataactactgtgagttattcaaggaatattgagttgttattttacctattcagtcatctggtgacctgtaaatcatttctgtgtgtttagagaattaa

SEQ ID NO: 206821 - DNA, 601 bp, Human
agagtatctttctgtcacccaggctggtctcaaactcctggtctcaagtgatctgcccacctcagcctcccaaaatgctgggattacaggcatgagccaccgtgcccggccccatgatatttttaaaccctgagtctcccatattctgatttttctactgttgccccagtctcattgcttagtatataaaccagaataaaattgatcctcaattccatctaagtcctactgtttcttggctgttgttttattaaaatcatgaagaaagcaaaaaaggcattccatcacaactattgaaaastgttctagaagttacagtcattgctataagaccaaacaggaaggaaaagatgaggtatgaatgttggaggagataaatgattattattagcaaataatggaaaatccaagagaataaagactaagacatcctaaatggaaagttcagtttggtgattaattacaaagtaaatatacaaaaataaatgtagtattcctgtgtatctgaaagaaacagatcatgtaataggaagaaaagatctcattcagaaagtaatgtgacatataaaaaataaaaaactaacattttaaaagaagtaca

SEQ ID NO: 206822 - DNA, 601 bp, Human
gtactgtgagttctgactaattacaggatagttttaaaatgttttgaacaaaaacaggattatggaatccacagagtagatgagactttaaatcccctcatcttaatccttggtttagccatgaagaaaaaaaaaagacctgaaagaggttaagtagtataatagtaggagtaaatgtaattttaaggttatacctctttgaaagggtaaggactcttaatgtaaatttcttactctcgcctcaaaatgtaagtacacactgggacgtattttttcattctgctgtttttattagatgttmtagaagtattgattgcttttatatatgaggtatatggcctgcatatgtttaggaagggctttctcaatcagtttaatctgctagcccaatttttaaccatatggtagaattcataatgctgttgattctctggtatgaataatatttattattccttatttttctttttcagtgagcatcaccagttttatcccacgttttaactttctaagcatagatctgccagtggttgtggagacatttgtcaagtatcctttctggtgtgaaacatgttttaaaagtgtgttacttggatcttga

SEQ ID NO: 206823 - DNA, 601 bp, Human
agctgtaccggtaagtcgagtcctgctttttggatatttagaaatattaattctagtatacattatccattttctgtatatttatttttttcagattaagtatcttcctgaagaaaatggtaagaattagttcaaatgcacagagagtgtttttgaacttttttccttcggcaagactaataataattttttttctcacttttaacagtacatgatgcagattttggtgaacagaaggatatttcagaaatcaatttaggtgagttcaatttttgtgttattaaagtcttgaaattacttraaacccagtggtgggattactgaacactttccttcctaatactgtattgtgattctctgggggagaaatattttttggtgctttgtgagaaattgcattttctgaaagataaaaatgcggaaagagaagatagttagaccagactttctaggagagctaggaagtcctcaatggatctagaaatatgtaacaagtttctctttataaaaattttatttttccaatttgtatttggaggaaaaggaaagcaaatagataattattccgattgttaaagaaaaatataagaataagcctctg

SEQ ID NO: 206824 - DNA, 601 bp, Human
ttgaggatccaccccagacctacagaattagcatcttcattttgacagacccaagtggtttctatgcacatcagagtgtgagtcaatctgcccctgactactcttccccttcctacttgagctttccagccaccctgactgcacagctactcctctaaggaagtgattttcgatgtgttgtccccaagccagcagcatcggcatcaccaggaaacttgttaggaatgaacattctcaggcctcaccccagacttaatggaccagaaatccaacggtgggggctcatcaacgggtgttgacyaagccttccaagggactctgatgctcaagtttaggaccactgccctaagacatcaaggctttcctgtcacaggacctttctatctggtgttgcctctacctcccctactcttccttcattccctcactctatcatatttctgctaaaatgccacctcctgtgggaggccctgcctgaccactctttaataaaatagcaaacctatctcacctcagcactctttcccactttacctttcatttgtttcttttttattgtacttttcaccatttgtcacactttacagttatttgtttattt

SEQ ID NO: 206825 - DNA, 601 bp, Human
agcaactggtagaaataagtaaatattagaagccacatgtaggcactggctgaccctcaagcagttgactgacagctgagcagccatgatgactcaatgtctgcaaggcccctcctgcttagacagatgaacaagattagagtgaagaagggaagccaggacagggttgcttagtcttgttgggctgctaggctgctcctactctcaggagatgtagattatgtttcagtattttccatcctctttatcagtgctgcctcgaatccctgtttatggagaacagctagatataaacaaatgytattgttcacagctattagttggaaaattgagttgttttctccagtgtttgccttgcaaattcacggaacatcaatacttaatggaacatgatttaagaaacaccaactttaaaaggggttctttcccattacaatttgttttatcctggttgtcacatctgcaccaccctattatgtgccaggctctgtgccttcatctgatattttatgtaacctttaccatgcctctgtaaggtgtaaggtagtgcttctcagactttaatgtgcataggactcagatgaggatcctgttaacctac

SEQ ID NO: 206826 - DNA, 601 bp, Human
ttatcagtgctgcctcgaatccctgtttatggagaacagctagatataaacaaatgttattgttcacagctattagttggaaaattgagttgttttctccagtgtttgccttgcaaattcacggaacatcaatacttaatggaacatgatttaagaaacaccaactttaaaaggggttctttcccattacaatttgttttatcctggttgtcacatctgcaccaccctattatgtgccaggctctgtgccttcatctgatattttatgtaacctttaccatgcctctgtaaggtgtaaggyagtgcttctcagactttaatgtgcataggactcagatgaggatcctgttaacctacagagtaggtcagcgttggtgtgtgagatgttgcatgtccaacggtcctctagtgatgctgatgctattggtccccacgcagaccacagcttaagtagtaaggtctctctagttgcaagataggtaagaaattatatttgagagtgatttgagacaagtgaactgacataagataaaggtattaaggatacagcagtatttctcaagcaataccacgtgaaggtcacctttagtgttaaagttca

SEQ ID NO: 206827 - DNA, 601 bp, Human
ctttctaggcagttcccatccccactccttaagagacaaccaccattctgattttcccctatgtattagttttgcctgatttacaactgatttacagataaatgaactcatataccatagtatttgttttataaatactatgtgtctggcttctttgacttatgttttttaagttcttccatattgttgtagatcaacagtaaattctttttttaaactactcagtaatatttctttgtaatactatactgtaaattactgtccatttttctgttggggctagtatgaagaaaactgttaygataattcttatacaagtttatgtgaatacattttttatttatctttggtaaatgcctaggaatataattgcttggtcatatggataactatgtaagaaaacgccaaacagttttccaaagtggctgtgccattgtacactcctcctgaaaatatatgagtgtttcatttgctccacatcctcgctaatattgatagcattaatctttgtagttatagccattttagtagttgtaaaatggtatctccctacgattttaatttgcatttccctaatgattagtgatatttagcacatttt

SEQ ID NO: 206828 - DNA, 601 bp, Human
ctttttcagatatatgtattataaatattttctgttagtctgttacttacctatttgtttttgtttttcaagcagtgaattttgaaatgcaaaagctttaaatgctgataaagtgtgatttatcaattttttaacttatggtttgtgtttttatattctaagaaatatgtgcttaaaccaagtcacaaagatatattccaatattttttgaagttgtatggtttcaatttttgtctataattgattgcaaactaattttgtgtacaacaggatgaagagattgagactgattggttggtayttattagcccagttgttccagcaacatttgctataaaattttgctttcctcattaagtactcttcgcaagagtctcgtttgccaagtttgccaagactcctcatttcttgatctggtatctctgttttcctatcttattctacttgtttatcatcatgtcaaaaatcactatgttgattactctagcttcacagttaaccttgaattgagtgttccagctttgctctccaatttcaagactgtttagcctactccagaccttttgcattttcatgtatattttacaatcaatttctctaa

SEQ ID NO: 206829 - DNA, 601 bp, Human
gggatagtatttttataatgaattcgattcatttaataattatagaattattcttattttctattatgctgcttttattaaattgtatttttcagtaataaaaaattaagattatcttaatagatgcagaaaaagcatttgacaaaattcaacaactatttcaactaagttgtcaaaatagtggcataatatctcattatctttataatgtctgtagaatctttagtgatagtcctatttcacttttgatattggcaatttgtgttttccctctttttttcttgacatgtcctgccagggrcttattgattttattaatatttttacagaattgacttttgatttgttaattttctcttgcttctctgctttatatttagttgctttctgttacctttattatttcctttctcctacttatttcaggtttagtttactcttcttttttgacattcttaagatgaaaattcatatcacttattttaaaccttcattttttctaatgtaatatattctacaacatggctactaaagctataattttatctgaagcactgctttactgccttcttcaaattttgatatggtgtatgcttattaa

SEQ ID NO: 206830 - DNA, 601 bp, Human
gatgacaaattctggtttttcttttacctgaaaatgatctttattttgcctaaattttgaggatattttaactggaaatagaatttcggtttatagtagtgttaaaaattattattttaacatttttaagttgtaatacattgtctttttgttttccaacatttgattataaaaacttttaaataatcaaaaagttaaaagcattatgcagcgaacattcacatactcataacctaaattacaattaacagttttatttgctttatttcgtctatccatcccaatatccctctatgaatctatcaatccattgtatttttgatgcatttcaaagtcgctttcgggcactagtacactttaccccagtcacctaagtatgcatgtaattaactacaggtcaatatttgtatatagttcccttttacataaaatatatatagggtaaaatgcatgagtctcagatgtacaattcaatgagttcttaaagatctatgcacctatgtaatccaaattcctatcaagagatggaacatgtttataatgtatgtacctctgaaacctaacttcctatgaagagatggaacactgttatccttccaga

SEQ ID NO: 206831 - DNA, 601 bp, Human
aaataaccaaatctgaaaaacgttaggccattatttgctcaaatatttttctgtgtttctcctgtccatcagagactctaactgcacatatcttagactgggtgatttttttcccattggtcactaaagcgctattcatttttctgaacatttttctctctgtctcttttaccatcgccagtcagcttttaaaattatccagtgaattttttatttttgatataatactgatagaattttcattgggttcttttatataattcccatttgtctgctgagattatttgtatgttcatctttwttccattaaattatgtaacaagtatacaatagagatttaaagtgtttgtctgttaagtctaacattttagtcaccttggggtctgtttctctttctagttattgcttttactaatatctatcaataacaatttcctgttccttcacaggtctcataatttttgattatatattagacattgtgttacattgtagtgattatgcgtgttttcattctcctctgaattgtgttaatttttgttagagcagttaaattactgcatgatcatctggaatttgtggaggattttgtggtcttgcc

SEQ ID NO: 206832 - DNA, 601 bp, Human
ttttgtatgtgaaaccatccctgcatccctggtatgaaacccacttgatcatgttgaattatctttttgatatgctgttggattcagttcatcagtacattattgaggatttttgcctgtgtgttcatcagggatattggtctgtagttttctttgtttgttatgtccttccctggtttgggtattaaggagatactggcttcatagaatgatttagggaggattccctctttctctatcttttggaatagtgtcactaggattggtaccaattcttctttgaatgtcttgtataattcakctctgaatccatctggtcctggacttttttttgttggcaatttttgaattgccatttcaatctcactacttgttatttgtctgttaagagattctatatattcctggtttaatctaggagggttgtatatttccaggaatttatccatctcttctaggttttctaatttatgcacataaaggtgttcaaagtagccttgaataatctttcatatttctgtggtatcagttgtaatagctcccattttgtttctaattgagcttattgggatcttctgtcttcttttcttggttaatctca

SEQ ID NO: 206833 - DNA, 601 bp, Human
caggaatttatccatctcttctaggttttctaatttatgcacataaaggtgttcaaagtagccttgaataatctttcatatttctgtggtatcagttgtaatagctcccattttgtttctaattgagcttattgggatcttctgtcttcttttcttggttaatctcactaataatctatcaattttatttattttttcaaagaaccagatttttgtttcatttgtcttttgtatttttttattccgtttcatttagttgtgctctgatatttgttgtttcttttcttatgctgggtttggrtttggattgttcttgtttctccaattctgtgtggtgtaaccttagattgtctatttgtgctctttcagactttttggtgtcatttaattctatgaactttcctcttagcactgcttttgctatatcccagaggttttgataggttgtgtcactattatcattcagtccaaaatttttttttaatttccatcttgatttcattgttgacccagtgatcattcaggggcaggttatttaatttccatgcatttgcatggttttgagggttctttttggagtgatttccaattctgtttgact

SEQ ID NO: 206834 - DNA, 601 bp, Human
agcagttcttgtagtactggcttggtagtggcaaattctctcagcatttatttgtttgaaaaagactgtatctttccttcgtttattaagcttagtttcaccagatactaaattcttgactaataattgttttgtttaaggaggttaaaaataggaccccaatgccttctagcttgtagggtttctgctgagaaatctgctgttaatctgataggttttcctttatgagttacctgatgcttttgcttcacagctcttaagattctttcctttgtcttgatttgagataacctgatgactrtgtgcctaggcgatgatctttttgagatgcatttcccaggtgttctttgagattcttatatttggatgtctagatctctagcaaggctggggaagttttcctcaattattccctcaaatacgttttccaaatatttggatttctccttcttctggtacaccaattattcttaggtttggatgtttaacatagtccaaacttcttcgaagctttgttcatttaaaaaatttttttgtttgtttttgatggatggggttaattcaaaagccttgcctttgagcactaagattctttcttctg

SEQ ID NO: 206835 - DNA, 601 bp, Human
tcttcgaagctttgttcatttaaaaaatttttttgtttgtttttgatggatggggttaattcaaaagccttgcctttgagcactaagattctttcttctgcttgttcgattctattgctgagactttccagtgcattttgcatttctctaagtatgtccttgatttccagaagttgtgattgttttttatttatgctatctatttcactgaagatttttcctttcatattctcatcatgtttttgatttctttaagttggactttacctttctctggtgcctccttgattggcttaataaytgaccttcaaaattctttttctggcaattcagagattttgtcttcatttggctccattgcggtgcactgacatgatcttttggcagtgttaaagaatcttgttttgacatatcaccagaattgtttttctggtcccttctcatttgggtagactgtgtcagagggaagatctggaattcaagggctgtttttcagatttttttgtcccacagggtgctcccttgatgtggtgttctcccccttcccctaggaatggggcttcttgagagctgaactgtagtgattgtttttgctcttctg

SEQ ID NO: 206836 - DNA, 601 bp, Human
tagagaaagatcaccaggttggagcagggataggcatgtctgagctcagcctctccttgggcagggcttgctgtggctgttgtggggaatgggggtgtggtttccagtccagtggagttatactccaggagggattatggctgcctctgctgagtcatacaggttgccaaggaagtggggaaaagcctgcagccacaggcctcaccctgctcccatgcagcccgcagtcctaaaggctgggcttattcccaccttgccccttcaacagcactgagtccatttccagtcgtctggtgaccarggttgagaacttgtcccggaccacgagcctccttgttgagaaagcaagcagactcacaggttttcagcatctcaggcaacctgcagttgtgatccagttccttcaaagggtctatggattgtcttggctttcctggtatgttcctgcagtagttctcggagcaaaaattcatgatgtgagtctccctacactgctctgtccaggcagctgcaagctaatcctgcctctcatcccccatcttaatcctgagtcctgaccgtggggttttgataatgatggatggatagtatgatgaaaatg

SEQ ID NO: 206837 - DNA, 601 bp, Human
atgtgagtctccctacactgctctgtccaggcagctgcaagctaatcctgcctctcatcccccatcttaatcctgagtcctgaccgtggggttttgataatgatggatggatagtatgatgaaaatggtagttagcacatgatttagcctcttaggaaaaaaaatgcaaaaaatagcagttaaataaaagaaaaatactgacaactacttagatacaaattaaatacctaacttacctgagtagttacttttggagcttattcatttatttatttatttattatttttttgagacagagtmtctctctgtcagccaggctggagtacagtggcatgatctcggctcactggaacctccatctcccgggctcaagcaattctcctgcctcagcctcttgagtagctgggatcacaggcgtgtgccaccatgcttggctaatttttgtatttttagtagagatgggggtttcaccatgttggccaggctggtcttgaactcctgacctcaggtaatcggcccacctcaacctccgaaagtgctgggattacaggcgtgagccaccattacaggcatgagccaccgcgcccggcctcattcttc

SEQ ID NO: 206838 - DNA, 601 bp, Human
atactgacaactacttagatacaaattaaatacctaacttacctgagtagttacttttggagcttattcatttatttatttatttattatttttttgagacagagtctctctctgtcagccaggctggagtacagtggcatgatctcggctcactggaacctccatctcccgggctcaagcaattctcctgcctcagcctcttgagtagctgggatcacaggcgtgtgccaccatgcttggctaatttttgtatttttagtagagatgggggtttcaccatgttggccaggctggtcttgwactcctgacctcaggtaatcggcccacctcaacctccgaaagtgctgggattacaggcgtgagccaccattacaggcatgagccaccgcgcccggcctcattcttctatttttaaaaaaattgcacacctactacattccaggaagtgtgctagactgtaggtgcaacaaaatatgcaatacggtcttagccctcagcaggcttacagttaccaggtgggggtggtggagaaatgagtatattgtcttaatacatgacaatgagtgtcctgggttgcagcagggcaagagtggggccact

SEQ ID NO: 206839 - DNA, 601 bp, Human
tttggtgcaaggttcattctatgctcagttttccactgtagaaagatgacttgatcaacagtggataaagaattgaaatagagcaagactggtggcaagagatcaattaacagatgctccagttttctaggggaaaaatggaaggtacctacaccaaggaagaggcaggtgatataaagaagagggaatggatttcagaaatctgtgaaaaagtgtatttatcagaacctaaccttatcaaattggttagtgggaggaggggttaggaaaggagaggagtcaaaagtatctgagatttcakatttggatgactggcaagtggtaacttcatttgctgaggctgggaatattgctgaaagaataactttggggatgaggtaggagagtaaactcatcttactgcatgtgttttattgcttgaggtttttgcaggtcatataaatggagataaccaatagtagttagatagtttatttttctgtaaaggggaaacatttaaagtatatctcaggccttgcaaagaccacacattttagggcctctctgcttttgactactgcattttgtcccttggcaatctctgaccttcaaggaagtgcta

SEQ ID NO: 206840 - DNA, 601 bp, Human
atagagcaagactggtggcaagagatcaattaacagatgctccagttttctaggggaaaaatggaaggtacctacaccaaggaagaggcaggtgatataaagaagagggaatggatttcagaaatctgtgaaaaagtgtatttatcagaacctaaccttatcaaattggttagtgggaggaggggttaggaaaggagaggagtcaaaagtatctgagatttcatatttggatgactggcaagtggtaacttcatttgctgaggctgggaatattgctgaaagaataactttggggatgagrtaggagagtaaactcatcttactgcatgtgttttattgcttgaggtttttgcaggtcatataaatggagataaccaatagtagttagatagtttatttttctgtaaaggggaaacatttaaagtatatctcaggccttgcaaagaccacacattttagggcctctctgcttttgactactgcattttgtcccttggcaatctctgaccttcaaggaagtgctaaaacccttaatttttcattgaaaacgtcagagaaacaattaactttattaacaaatttatttccattcttcagctac

SEQ ID NO: 206841 - DNA, 601 bp, Human
ttttaaagtcatttctctggatgtgaaatctcctgtgcctctagaaggctgtttgaggtttagttgattattccatgactatagggcatactcaagaagtattttttccagttgctttaccaaatcaataaaaaatgtttaaaaacaaaaacaaaaataaatgcttttatctgaaataacaccccaattatgttaattctagctagttatctgggttctgattaatcaaaggtgaatgtttttttcttccttgtttctaagcaccttgcttcttctgcctccacctcatacaatgcaaaakacaacagttttgtcttacgtattattccgttgtattattttaactatttcattgttctttaggttgttttgttttgttttgagacagagttttgctcttgtggcccaggctggagtgcaatggtgcgatctcagctcactgcaacctctgcctcctgagttcaagcgattctcctgcctcagggaggcagatgggattataggtgtgtgtcaccatgcctggctaattctgtattttttaagtagagatgggatttcatcatgttggttaggctggtcttgaactcctgacctcaggtga

SEQ ID NO: 206842 - DNA, 601 bp, Human
tttttccagttgctttaccaaatcaataaaaaatgtttaaaaacaaaaacaaaaataaatgcttttatctgaaataacaccccaattatgttaattctagctagttatctgggttctgattaatcaaaggtgaatgtttttttcttccttgtttctaagcaccttgcttcttctgcctccacctcatacaatgcaaaagacaacagttttgtcttacgtattattccgttgtattattttaactatttcattgttctttaggttgttttgttttgttttgagacagagttttgctcttgtkgcccaggctggagtgcaatggtgcgatctcagctcactgcaacctctgcctcctgagttcaagcgattctcctgcctcagggaggcagatgggattataggtgtgtgtcaccatgcctggctaattctgtattttttaagtagagatgggatttcatcatgttggttaggctggtcttgaactcctgacctcaggtgatcggcctgccttggcctcccaaagtgctgggattacaggcatgagccaccaccgtgtccggcccttactttccttaattgtttgagacaatgaagtagagtg

SEQ ID NO: 206843 - DNA, 601 bp, Human
ataaaaaatgtttaaaaacaaaaacaaaaataaatgcttttatctgaaataacaccccaattatgttaattctagctagttatctgggttctgattaatcaaaggtgaatgtttttttcttccttgtttctaagcaccttgcttcttctgcctccacctcatacaatgcaaaagacaacagttttgtcttacgtattattccgttgtattattttaactatttcattgttctttaggttgttttgttttgttttgagacagagttttgctcttgtggcccaggctggagtgcaatggtgcratctcagctcactgcaacctctgcctcctgagttcaagcgattctcctgcctcagggaggcagatgggattataggtgtgtgtcaccatgcctggctaattctgtattttttaagtagagatgggatttcatcatgttggttaggctggtcttgaactcctgacctcaggtgatcggcctgccttggcctcccaaagtgctgggattacaggcatgagccaccaccgtgtccggcccttactttccttaattgtttgagacaatgaagtagagtgcttttgagtacactaaaacatttat

SEQ ID NO: 206844 - DNA, 601 bp, Human
tctgtattttttaagtagagatgggatttcatcatgttggttaggctggtcttgaactcctgacctcaggtgatcggcctgccttggcctcccaaagtgctgggattacaggcatgagccaccaccgtgtccggcccttactttccttaattgtttgagacaatgaagtagagtgcttttgagtacactaaaacatttattgagcagcttcctgatgtggtagaaaaaaaaaaagtcaatgctgtgtttctgaagatacctagtttttaagaaggaattagtgaagagaatgcaaaaacaytgtttttggcagtaagagattaatgaaactttaatatatttaaaatgccttaactgtttccggcatggcttttataaaacaaataatagccttgtgtaggtatctgttttatttagatcccaattttatatgcggattcatatattgcagtgcatctataataattttacttttgggggcttggaagaactgaccaagctttataattaaatatgaatcctcaaaagttttctgccaggactgtagtagttcattttggagtaagatggtcaatgattttcacatgagatgagggtagag

SEQ ID NO: 206845 - DNA, 601 bp, Human
ttatggaaacacaatcataaccatttgtttaagtattgtatatggctgttttcgtgctacaatggcagagttgagtagttacaacagagaacatattttctatctactctagaacaggtttgctgactgatccctggtttacaggatcgcatgccctggattacagccccttttcaagtctcagctgtgagtccctatcctattcactgttgggggcactaccaacctagcacagctcttagtagacactaggcccaacaaaaacatgttgaatacattttcaaatattattcaaaatatwtgtttgttaagtattctcataagaatccatgagtaacacagattaaaataatctattctaacctgatgggatttttgtttttgttttgagacagagccttgctctgtcttccaggctggagtgcaacggtgcaatctcagctcactacaacctccacctcctgggttcaagcgattctcatgcctcagcctcctgaatagctgggatgactggcgtccaccaccatgcccagctaatttttgtattttttagtagagatggggtttcaccatgtggaccaggctggtctcgaactcctgg

SEQ ID NO: 206846 - DNA, 601 bp, Human
attgtttgaacccaggaggcagaggttgcagtgagctgagatcttgccattgcacaccagcctgggcaacagagcaaaaactccgtctcaaaactaaacaagtaaacaaacaaaaagtgactggacaaggagctagagaaggagaatacgaggatgggaagttatgactggaagagttagctgcatttgcattcagttttcctatcactccacaagaagaaaatcaaaaaaatctgcaaacctttccattaatgcagcccaaacagtaaattcccgatggttattagtcaattcaaagacmctctgatcagttattttgttcagctttttacattgcagcacatcttatctcactttcactaatctcagaaaaatatttacctttcctcttttgataggaaaataagttttcttcttcctattttatttttgttctccatgaggctatttctgaaacagaaggatgtgagccttgattggcaggatcccctgtcttgctttcagctgcttacctttccctctgcccctcagatttccttctcctaacccatgaagagtaggccaggtacagctctgggcagactcagtggatgaggtactt

SEQ ID NO: 206847 - DNA, 601 bp, Human
caaaaaaatctgcaaacctttccattaatgcagcccaaacagtaaattcccgatggttattagtcaattcaaagacactctgatcagttattttgttcagctttttacattgcagcacatcttatctcactttcactaatctcagaaaaatatttacctttcctcttttgataggaaaataagttttcttcttcctattttatttttgttctccatgaggctatttctgaaacagaaggatgtgagccttgattggcaggatcccctgtcttgctttcagctgcttacctttccctctgcycctcagatttccttctcctaacccatgaagagtaggccaggtacagctctgggcagactcagtggatgaggtacttggctgttagaacgatgtgtcttgaacataattgattgtgaacattttcctgaattcaaaaattatttttcctgtcatttggaataccttcctcagctttgctattttaccttctctttctgaaagtcttacacacacgtacacacacacccagatacacacgtatttatatatatttataatgtatctttggtgtaaacatgtacatgtatttagtcatttcta

SEQ ID NO: 206848 - DNA, 601 bp, Human
aattcaaagacactctgatcagttattttgttcagctttttacattgcagcacatcttatctcactttcactaatctcagaaaaatatttacctttcctcttttgataggaaaataagttttcttcttcctattttatttttgttctccatgaggctatttctgaaacagaaggatgtgagccttgattggcaggatcccctgtcttgctttcagctgcttacctttccctctgcccctcagatttccttctcctaacccatgaagagtaggccaggtacagctctgggcagactcagtgkatgaggtacttggctgttagaacgatgtgtcttgaacataattgattgtgaacattttcctgaattcaaaaattatttttcctgtcatttggaataccttcctcagctttgctattttaccttctctttctgaaagtcttacacacacgtacacacacacccagatacacacgtatttatatatatttataatgtatctttggtgtaaacatgtacatgtatttagtcatttctaatatttatttaaatttacaatatgtattttatagttattacaatattatatatgttattgtatat

SEQ ID NO: 206849 - DNA, 601 bp, Human
aaataaatctatttaatatatatatttaaatagaactatttcccttttttggagggtctctgggtatctagtcaaagagtagcatggggaaaataacatgactgagaaggacctgtggattctctccctaacaggttaccagcacaactttgacacctatgatgatagcttaatcacagacctcaatacaccctatgattatgagtctttgatgcactaccagcctttctcatttaacaagaatgcaagtgttcccaccatcacagccaagatccctgagtttaactccattatcggacarcgcctggatttcagtgccattgatttagagaggctgaaccgaatgtacaattgcagtgagtatctcagtttctgagaacttggtaaactagcctcagcagagattccatcagccttagagatttcctttacattttcctttactcttctttaatgtactagctaaaagaataagaacaaactgcgtaacttttgttggtctacctctagacccatttgtttaagtattgtctatggctgtttttgcgcttcaatggcagagttgagtagttaaaaacaaaaaacaaacaaaactataaca

SEQ ID NO: 206850 - DNA, 601 bp, Human
tttgattctgttcaataagtatgtacaaaagacctactaagtacaaagccaaatattataggtatcttgttcttgatctaaaggagtttatggttggtatttacatggcagagaatgattatagttttttttatcttgactctgtgaggtaggtagggctgtgtctatatattagcaagtactaagatctgatgacagtaagatttgcatttgagaaaaagtcaagataacaagcttgtgatcctgtcatatctgaacaatgaggttttagtggcttaagacattagctatttggaatgastatctttcatttttaaccagatgataaaaatataatttgcagccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtcagtgaaagtggaaagcaaacacattgatgtggttcaccaggttcaattaggttatgccagccaccatgttttgcctcagtcagaatgttagttatcaaacttgaa

SEQ ID NO: 206851 - DNA, 601 bp, Human
aagatttgcatttgagaaaaagtcaagataacaagcttgtgatcctgtcatatctgaacaatgaggttttagtggcttaagacattagctatttggaatgactatctttcatttttaaccagatgataaaaatataatttgcagccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtcagtsaaagtggaaagcaaacacattgatgtggttcaccaggttcaattaggttatgccagccaccatgttttgcctcagtcagaatgttagttatcaaacttgaaaatctgaacaaggacaaaaaacatttcttatatcttcattattaactcagtaaaaagcatccagtctctgggcacacaaaagaaagatgcatttaagcaaaactgatattagtatatgattgataagataaaacctcataaataaaggcaatgtctctagaaccacaccctcctacagaaatataatgtgagtcacata

SEQ ID NO: 206852 - DNA, 601 bp, Human
aaagactagactattgcaaagtcacttagtccgtaactgtctgagagttggtgagattcccttcccagaaggaacacagcctgtcacccagataccaggccaccacagggaatgtcagaggtgataagccactgacacttttcctccatctttggaagagggtaaaagcttctgtcacagatcagattatcaaacatatcatcccaagtgtccaaaggttgatccaagcctgaagtgctctctaaatttctgttgtagcctctaatccaacctagtctgtgggcttgctgttaggctaatrtacaattgccagctaaacacaaaggtgatctttattgtgagcggaatctgctgaaaaaatgttctagtaagagaaaaggaccacagcccagaagaaagatctggaaaagctgtatcaggttaacttgagcagctattatgcttctttcacaagaggtatttaatggaacatgtccctctgctagagagctcttgcatagttacaggtggatgcgtagacacaaagagcttgaaggatccattgggaggatccctcccattcaaaacccacggaaataaacacctagggagagctggggat

SEQ ID NO: 206853 - DNA, 601 bp, Human
agcattttgatatggagttgagtgttggaacacagtataaagaacctcttcatatgcaagaatttttcattgtgcttgactttgacaagtgtgtggtttaccaaacggtacatttgtttggctgcttgactgtttttaggggaaagagttttgagatatctgagtcaggtaaaccctatctctggcactaatgtagacacttttcaccctcttcagtgtccttccaattccttcctttacattcaggggaaatttccatttagtctctaatgtgtcctgaatagcccttcttataatataktaaagattacttttttgccactgataatacacccagttattaggctagcaacaggggaaattgaacccttatcattgtcaatgtttaaaaccaaatcctaaatctttgaattccagtgtcttatacaacaaccagaccaacccaactcttttccttggaatgaatctctaatttaaagaatgaagtcaatgagaaaaatagaattcatctcacagacacaaaattccatcaaacattgcttgaagcctgtgtttctttaagtcagaggtatatatttcacaatcttggaacaaaggcaat

SEQ ID NO: 206854 - DNA, 601 bp, Human
aatcagctccaccctaagaaacagaacattgttagacctgtcccttgaagttgtacttagagagaatggcctgaaaacacaagggagattaaaggtcttttccttttcagggaaagtatagttctataagtagatatctggttaaaagacacagaagaaggaaaaaagacactcatctgtaggaactcagtttagccaacatgacttccacttggaagcatttttcctctcctcttcaagcccaactctagggaataccctgtgcaaaaatatcagtgtaggcacatctctttgcggaatygagttgctttgctttcgcagtttcctctctccagtacccccaagctcctgtctggcttcttatactgttcaacccaggatcctatgttctagaacggccttctcaccatctttcctcagctcttaattcgaaagtcccacttctagttcatgctcagagaaaaagcaagtagacctaatctttattagaacgtgcatttccagacaatagtactctatttggcttactttgctcccctacatggtggactttcagataatataaggaagagaaaaaagtctagatgttggagagggagtc

SEQ ID NO: 206855 - DNA, 601 bp, Human
tcatgctcagagaaaaagcaagtagacctaatctttattagaacgtgcatttccagacaatagtactctatttggcttactttgctcccctacatggtggactttcagataatataaggaagagaaaaaagtctagatgttggagagggagtcagttttaggtagggaagatccagtcagtcctacaggttattatctgctcttcagcattccttatagctctctggcaacaagtgacaggtcggaccatatggagttactattttttttacttttggcttagaaaatggctattttataygattcagcctaacacttgggttttctttgctaaccttaggggttacagttgaaccagccaactcaggaggaaatccagaacctggattcttatagtggaaaacaaattcacggttaagatttgaatgtgaattttaaaataaatcatagtattttaaaaaacaatttttccttattaggtatgtaactttggaaaagttacttaaccagtttataacagtacctattttatagggctgttgtgaggatttaatgagataatttatggaaagcacatggcactgtgccaaactcataataa

SEQ ID NO: 206856 - DNA, 601 bp, Human
tgttactatgttcatgaagtaaacttacatcagtaaagaaatgggcaaactattttttttttttttttgagatggagtctccctctgtcgcccaggctgcaatgtaatggcgcattctcggctcactgcaacctccacctcccaggttcaaacaattcttctgtctcagactcccgagtagagatggggtttcaccgtgttgcccaggctggtcttgaactcctgagctcaggcaatccacccgctttggcctcccaaagtgctaggattacaggcgtgagccaccacgcctggcactaawttttttttttttcaaaagagaagacttaagccttagaagaaagaagccgtagctgtccctctcttttcattaagaaagtcgctcagtagcagacaactgatcactcagagctgtgattctctgcctctcccatctttcaattctgaattgcaattctcctggaaatagtaaatagcctaatttttttccaacactttttttatttttatatttatttatttatttatttatttatttatttatttatttatttatttctgattcacaaagccctgtatcctcattaaagacaaactggaa

SEQ ID NO: 206857 - DNA, 601 bp, Human
ggcctcattctccaaggccaggagcagcaggtctccgaagaaggttcgggaaaggccatgttagaggaagccctacctgtcagcctgagccaggggcagcccagccgacagaagcggtcggtggagaacacaggccccctggaggaccataactggccacagtacttcagagacccatgtgacccaaacccttgccaaaatgacggcatctgtgtgaacgtgaaggggatggcgagctgcaggtaggctctgtggctggggagacaggcaggccagcagacctgggccgtgtgcatgcttrctcctggtaaaggctgctgtttgcagagtagggcgaagactacctcagatggtcaactgaatgcggttttctttgactctacaaaggtgtgccctggattcatgggcttatgctgccaggacagaggcttcccaggtcaccttgtctcttgactttcaccccttttcccctcttctggggtattgtcaacagcatcttggatgttgttggaatttctaactctaacaacacccaagatggcttctagcctagggactttctactccatgagggtgggtctcaagaccaagcttaaatctt

SEQ ID NO: 206858 - DNA, 601 bp, Human
caggcaggccagcagacctgggccgtgtgcatgcttgctcctggtaaaggctgctgtttgcagagtagggcgaagactacctcagatggtcaactgaatgcggttttctttgactctacaaaggtgtgccctggattcatgggcttatgctgccaggacagaggcttcccaggtcaccttgtctcttgactttcaccccttttcccctcttctggggtattgtcaacagcatcttggatgttgttggaatttctaactctaacaacacccaagatggcttctagcctagggactttctacyccatgagggtgggtctcaagaccaagcttaaatctttgctgactacagatgttattagttcctaattattattagttctatagtctgtcatttacactgtactattattacagttatattttcaataatagtagtaagaacacctgatatttctgaccccttgttatgcatcatgtagtctcctgagcatcttacacgcatgatctaaattcattctcactgccacctgtgacataagggctctccttatccccgtttagtgtgtcaagaagttgaagcttagaaagattaagtaattta

SEQ ID NO: 206859 - DNA, 601 bp, Human
atattttcaataatagtagtaagaacacctgatatttctgaccccttgttatgcatcatgtagtctcctgagcatcttacacgcatgatctaaattcattctcactgccacctgtgacataagggctctccttatccccgtttagtgtgtcaagaagttgaagcttagaaagattaagtaatttatctaaaatgtacccagatggaaaatgctgaagctgggacttgcatctaggtctgtctggcagcacagtttgctatattttatagttctttttataatgtttgcttgcataaaaccytaaaaactgtttcacaaaaggaggtatgtgatgacagaagcaacagttccatttgaacagtagcagatgtagaagctattctgcctgcctcaaaaatttacatttcttctgagttctttttagtctccttttttttctctttttgtagcttttattttgaaataattttagacttacagatacaatgcaaaaatactacagaggttttctctataccattcacccagctttccctaatgttagcatattacacaaaccatagtacaattagcatagccaagaaatgaacattggtacaat

SEQ ID NO: 206860 - DNA, 601 bp, Human
cattatctggccaacagcatgtccaccaggcctctccactgaagagttaccatttctccctctgtaattaatacgtatattgggagagatattccaagaccatggagacattctgcttttcctcaaatcctcacacactaatttcagcatctgttgacacatcctgctgcaatactcaccactgagatcttctaatgttgatttcctatatccttcacattcattaattataatctcctgtaaagaagaatggcaccttcaccccgttaatttgtttatgtgattgtttattcacatcacraaggaatcataaacattaattttattcagtgggctctgttgcaataatttcatgatttattttgttgcttctattgtcccagctttggcctttgggagctcttccaggttggctcctgtgctctttcaacatcagattttatgaacacaatgttactttctggcaccataacatgctctaggctcatctttaatttttcctgccccacccatagaatcaatcactcttccaagaagccctctggttccttttactggggaaggcccatctgtttctgggctccaaagccataggtctgca

SEQ ID NO: 206861 - DNA, 601 bp, Human
atgtccaccaggcctctccactgaagagttaccatttctccctctgtaattaatacgtatattgggagagatattccaagaccatggagacattctgcttttcctcaaatcctcacacactaatttcagcatctgttgacacatcctgctgcaatactcaccactgagatcttctaatgttgatttcctatatccttcacattcattaattataatctcctgtaaagaagaatggcaccttcaccccgttaatttgtttatgtgattgtttattcacatcacgaaggaatcataaacattwattttattcagtgggctctgttgcaataatttcatgatttattttgttgcttctattgtcccagctttggcctttgggagctcttccaggttggctcctgtgctctttcaacatcagattttatgaacacaatgttactttctggcaccataacatgctctaggctcatctttaatttttcctgccccacccatagaatcaatcactcttccaagaagccctctggttccttttactggggaaggcccatctgtttctgggctccaaagccataggtctgcatatctttgcctgacaggc

SEQ ID NO: 206862 - DNA, 601 bp, Human
tttttactggggagagttatgtccctgtctgacagctctaaagagagcagtggttctcccagcatggcgtatgagctctgagaagggacagactgcctcctcaagtgggtccctgacccccgtatagcctaactgggactcacctcccaacaggggccaacagacacctcataaaggcagctgcccctcccggatgaagcttccagaggaaggatcaagcagcaatatttgctgttctgcaatatttgccgttctgcaacatccactggtgatacccaggcgaacaaggtctggagtggamctccagcaaaatccaacagacctgcagctgagggacctgactgttagaaggaaaactaacaaacagaaatgaatagcatcaacataaacaaaaaggtcatctacaccaaaaccccatctgtaggtcaccaacatcaaagaccaaaggtagataaaaccacaaagatggggagaaatcagagcagaaaagctgaaaattctaaaaatcagagcgcatcttctcctccaaaggatcacagctctttgccagcaatggaacaaagctgaaaggagaatgactttgaggagttgacagaagtag

SEQ ID NO: 206863 - DNA, 601 bp, Human
aacacataacttaagaaagtttttactggggagagttatgtccctgtctgacagctctaaagagagcagtggttctcccagcatggcgtatgagctctgagaagggacagactgcctcctcaagtgggtccctgacccccgtatagcctaactgggactcacctcccaacaggggccaacagacacctcataaaggcagctgcccctcccggatgaagcttccagaggaaggatcaagcagcaatatttgctgttctgcaatatttgccgttctgcaacatccactggtgatacccaggcraacaaggtctggagtggacctccagcaaaatccaacagacctgcagctgagggacctgactgttagaaggaaaactaacaaacagaaatgaatagcatcaacataaacaaaaaggtcatctacaccaaaaccccatctgtaggtcaccaacatcaaagaccaaaggtagataaaaccacaaagatggggagaaatcagagcagaaaagctgaaaattctaaaaatcagagcgcatcttctcctccaaaggatcacagctctttgccagcaatggaacaaagctgaaaggagaatgacttt

SEQ ID NO: 206864 - DNA, 601 bp, Human
cccgtatatgagcgacagttttctccattcacaagtatcacttttagattatcttgtaaaacttaagcacatagtcccaacaaattacaaagatgcactgatctgtggtaaacacataacttaagaaagtttttactggggagagttatgtccctgtctgacagctctaaagagagcagtggttctcccagcatggcgtatgagctctgagaagggacagactgcctcctcaagtgggtccctgacccccgtatagcctaactgggactcacctcccaacaggggccaacagacacctcayaaaggcagctgcccctcccggatgaagcttccagaggaaggatcaagcagcaatatttgctgttctgcaatatttgccgttctgcaacatccactggtgatacccaggcgaacaaggtctggagtggacctccagcaaaatccaacagacctgcagctgagggacctgactgttagaaggaaaactaacaaacagaaatgaatagcatcaacataaacaaaaaggtcatctacaccaaaaccccatctgtaggtcaccaacatcaaagaccaaaggtagataaaaccacaaagatgggga

SEQ ID NO: 206865 - DNA, 601 bp, Human
tatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagattgaaagctaggttaataaggctgttaaattgaagaaaatgattttttttttttttgagacggagtctcattctgtcgcccagactggagtccagtggmgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttcggcctcccgaagtgctgggattacaggcgtgagccactgctcccggccgagaaactgttacattattagcatcagaggaaggcccttaccacactcc

SEQ ID NO: 206866 - DNA, 601 bp, Human
tatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagattgaaagctaggttaataaggctgttaaattgaagaaaatgattttttttttttttgagacggagtctcattctgtcgcccagactggagtccagtggcgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttcggcctcccgaagtgctgggattacaggcgtgagccactgctcccggccgagaaa

SEQ ID NO: 206867 - DNA, 601 bp, Human
gtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagatygaaagctaggttaataaggctgttaaattgaagaaaatgattttttttttttttgagacggagtctcattctgtcgcccagactggagtccagtggcgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttc

SEQ ID NO: 206868 - DNA, 601 bp, Human
tggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataaaagtttctttagatgccacraaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttg

SEQ ID NO: 206869 - DNA, 601 bp, Human
cttggctgaattcccaaatgtggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataraagtttctttagatgccacaaaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaa

SEQ ID NO: 206870 - DNA, 601 bp, Human
aacagccaaattgcaaatacctcaagagagtagctattgtagaaaagaacagaaactcaaaacacggtataagataaacgaccagataaacactaaggcactgtaaatttaaatgatggacactgtccagaatatgtccaattattattggtgtctccaggcaacttttctaaccattagtagcaaaaaaccaaaaaggtcaaactacacttgtcccttggcatttgtggagaactggtcccaggaccccctcacagatttgtatccagggatcctcaagtcccttatataaaatggcaargtatttgcgtataacctatgcacatcctctcatataccttaaaccatttctatattacttacaatacccaatacaatgtaaaggctatataaactgttattaaactgtgtttttttatttgtattattttttattgttgtgttattttgtattgggtttttttcccctgggtattttagatctacacttggctgaattcccaaatgtggaattcgtgtccccagagggcccactatattgtttcttcactacttactactactactactcacaattttagtcccagatacttgcttaaag

SEQ ID NO: 206871 - DNA, 601 bp, Human
aagcatcagaagtaacttgagaacagccaaattgcaaatacctcaagagagtagctattgtagaaaagaacagaaactcaaaacacggtataagataaacgaccagataaacactaaggcactgtaaatttaaatgatggacactgtccagaatatgtccaattattattggtgtctccaggcaacttttctaaccattagtagcaaaaaaccaaaaaggtcaaactacacttgtcccttggcatttgtggagaactggtcccaggaccccctcacagatttgtatccagggatcctcaartcccttatataaaatggcaaagtatttgcgtataacctatgcacatcctctcatataccttaaaccatttctatattacttacaatacccaatacaatgtaaaggctatataaactgttattaaactgtgtttttttatttgtattattttttattgttgtgttattttgtattgggtttttttcccctgggtattttagatctacacttggctgaattcccaaatgtggaattcgtgtccccagagggcccactatattgtttcttcactacttactactactactactcacaatttta

SEQ ID NO: 206872 - DNA, 601 bp, Human
ttgaggaagtttttaaacgggtgacaagaatttttcagagaaaaaggaaagatgccattgaaaaagaagtcaacaatacactgagaaaacaaataaaagtaaaaagttcctgagacaaaagagggatggagagttcagcctccgataagaggcaaaatatagttgtaataaaatcaaagtggtagaacgcagtgagccagactgtccgtgttcaaatcccagctcctccacctacttgctgtatgactttggtcctatagtcagagaacttagtctctctgtgtttcgtttctctcacctrtaaaatggtaataataataatagcagttcttcacagagctgctgccaaattttatatacagggcagagaagagtaccttggcttacttagcatcttaatgacttgttttccattattgttatcattaataaaagtataggctcagaaatcagaccatgtgtaaatcctggcttggccactgtctagcagtgagtccaagaagaaattatatatcctctctgcttctcagttttgtcatctataaaacaaatatacctgaaagggtttttgtggagcttcagtgagatgatctttgtaaag

SEQ ID NO: 206873 - DNA, 601 bp, Human
tttttgagacagggtctcactctgttgccaaggctaaagtgcagtgttgtgatctcggctcactgcaacctccgcctcctgggttcaagcgattctcatgcctcagcctcccaagtagctggaatttacaggtgtgcaccaccagccccacccagctaatttttgtatttttagtagagacagggtttcaccatgttggccaggctggtcttgaactcctgactttgagtgatccacccaccttggcctcccaaagtgctgggattacaggaatgagccaccatgcctggctgtttctacrttttaaatgtataatgtctcactattagctataactactgaggtatagatttgtctttatttatggtaacagtgtcacctactggattaggcacatcgtatgcaactcccttcccaaacacaggtgttgtcaggcgactgtagacatcttctgcattcaggtcttcatttttactattaaaaagcagtgcagcagcatcactccccagaaggtaagtaaatgtcttgcctaccatggtaaaactaaatacaggtccatactaaaaagagaaaagtacatatagtgatgttacaaaaaata

SEQ ID NO: 206874 - DNA, 601 bp, Human
ctctaaacagcgcttatgttagaatttcaggcaggaatgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaaccaaggaataaactggttctacattttattacatttttgtttggttggtttccgtgtgtgtgtgtgtgtgtgtgtgtgtgtgtgtgcgtgtgtgtgtgtgtgtttggttttttgtttctgtttttgagacagggtctcactctgttgccaaggctaaagtgcagtgttgtgatctcggctcactgcaacctccgcctcctgggttcaagcgattctcatgcctcagcctcccaagtagctggaatttacaggtgtgcaccaccagccccacccagctaatttttgtatttttagtagagacagggtttcaccatgttggccaggctggtcttgaactcctgactttgagtgat

SEQ ID NO: 206875 - DNA, 601 bp, Human
ttaaggagaggcattcattccctcattccccatcactagaaacaagatttaatgttaactcttaactgctatactagggtactggctaatgtgtgttacattcacagccagagcccataccaagcattggggccaattgtctgatttgtgttctatatcaacttaaaacaatttcgtatttggcttttgagggtaaaacatacacatagatgtaccccacacgtgaagttgttgcattaaaagaggacttctgaagtcagcaatctctaaacagcgcttatgttagaatttcaggcaggartgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaaccaaggaataaactggttctacattttattacatttttgtttggttggtttctgtgtgtgtgtgtgtgtgtgtgtgtgtgtgtgtgcgt

SEQ ID NO: 206876 - DNA, 601 bp, Human
tagatctatctgactctaaatgaatagagtctaaatgaatatatatatctgaacagagggattttccagggccctgttttttggccttaaggagaggcattcattccctcattccccatcactagaaacaagatttaatgttaactcttaactgctatactagggtactggctaatgtgtgttacattcacagccagagcccataccaagcattggggccaattgtctgatttgtgttctatatcaacttaaaacaatttcgtatttggcttttgagggtaaaacatacacatagatgtaycccacacgtgaagttgttgcattaaaagaggacttctgaagtcagcaatctctaaacagcgcttatgttagaatttcaggcaggaatgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaacca

SEQ ID NO: 206877 - DNA, 601 bp, Human
ggcagtccctgtccttaagaaacagaaaattaaataaaggcacaaatatttaaaacaaagaaacttcacaatacaataaaaagccaccaaagatttcaaacaagtgctagagaagagctgtatcacttttaggtatagttcagagactttcctgaggataaggaatacgtgaggtaagcaggcttttaaactaggctgggctcagtggctcacgcctgtaatcctaacactttgggaggctgaggcaggtggatcacctgaggtcaggagtttgaaaccagcctggccaacatgatgaaaycctgtctctactaaaaatagaaaaattagttgggcatggtggcacgtgcctgtagtcccagctctcaggaggatgaggcaggagaattgcttgaacacaggaggcagagactgcagtgagccgagatcacaccactgcactacagctggggcaacagagcaagactccatctcaaaaacaaaaacataaataaaatattagactagacagacaacaaatcacctttttaataaactgaaacttactttaaatgagctcattatataaagaaaatttgtcttgaattcttatagaagaaag

SEQ ID NO: 206878 - DNA, 601 bp, Human
atgactctaaaataattgacaaaaaaatcagaaccaggaacatactggaagtcatgaaaatcttacattgttaaaaatgtccatagtccctaagggcaagaactgtgctttatttaacatatatatcccagattcttaacacattgcctgtgttcaaactaaaggcctaaaacaagcaagaaattcctttagaagtattttccagttcaacagaaagtaggatactcttttaaattaacataaaattccaattttaataccaaatcaagtcttaaagcagaagagtcactctggttcttcyatggaatctggttctacttttcactttctaatacaatagttttttgtagggggtgaaaatactagcagattcagaaaacaagcttcaactcctaaactttacctttaaatagtatgttcactatgtagcaggtaccatgttaagtgttttacatgaattactcacttttatcttcctgtgaggtacatactattaacctcaagttatagctagctgcataagatcacacagaaagcaaacattggagctggaatttaaaactaggcagtctgactcccaagccccctcttaaatcaagcc

SEQ ID NO: 206879 - DNA, 601 bp, Human
ctcaaagtcataaggcagcaatgaaactgaaaaatccaacaaacctggtcataagttaaaggaggcagattctctccacagactgttttctgttctaaataacattttttttgaagtgttttgtctctggccaaaaagaagcccatccaagcactagtagttgaggatgtatgctgccctgccaagagtaatccaataagcatccctgctacttcatcatcagtcaaaggacgcccatccctaaggaatgaaccaaagacacaaatttaacattttggcagatacatttcatgcctcaacmtttaaataaagtgtcataatgaatacatttttcaggtatagtggtctcttatatttgactatcacaagtcaagagttttttttctcttagggaagagacagaccagcacaaaacgattttgattacaaaagactccattacagttcattagcaaacttttaccatacccagtcactgggattacagtaagacacaggatgccaatagtttatgtctcaacaatttaaagagtccaaagatcacagctaccaacttattttgccagcatcactgttttttaactggaaatactatttaact

SEQ ID NO: 206880 - DNA, 601 bp, Human
aaatcagtacacaaacgtttagagcggcattattcataatagtttaaaaggtggaaacaactcaaatgtccatcaactgatgaacaaataaacaaaatgtggtctatccatataatggaatattattggtaataacaaagactgaagtactgatacatgctacaacatggaagaaccctgataacatgctaagtgaaacaaggtagtcacaaaagactacaaattgtatgatcccatttacatgaaatatccagaataggcaaactcacagaggcaaaaggagattaatggttgccagggrcagcagtcagggagaatgaagcatgactgctaatgggtaccagctctcttttgggagtgatgtaaatgttctaaaattaaattatgatgatggtttcccaactcttaatatgctaaaaaccacaaagtgtacattttaaatggatggatttatgctatgtaaatatatcagttaagctgttattttaagttactaaaaacaagaatgagtgttgagacatcactactgagcttacagaaataaaaaggattatgagaatactatgaacaattgtatgccaacaaattaggtaacctagat

SEQ ID NO: 206881 - DNA, 601 bp, Human
acatcactagtcaccagggaaatgcaaaatcaaaacaaaataccaactgggcatggtggctcacacctgtaatcccagcactttgggaggccaaggcgggcagatgacttgaggtcaggagttcaagaccagcctggccaatatggtacaaccttgtctctaccaaaaatacaaaaattagccaggcgtggtggtgtgtacccagctacttgggaggctgaggaaggagaatagcttgaacctgggaagccgaggttgcagtaagccaaggtcgcgccattgcactagagcctgggcatcrcaccaagactctgtctcaaaaaaaaaaaaaaaagtatcacttcacacctattataataaaaaaatcaagtaacaagtttggtgagggggtgaagtcaggaccaacatatactgtttagtgagatttgaaagtggtgcagccactttttaaaacagtctggcagttcttcaaagttaccttataacccagcaattctactcctaggtatgaccccccaaaattgaaaacacatgtccacataaaatcagtacacaaacgtttagagcggcattattcataatagtttaaaaggtggaaaca

SEQ ID NO: 206882 - DNA, 601 bp, Human
aaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaaataccaactgggcatggtggctcacacctgtaatcccagcactttgggaggccaaggcgggcagatgacttgaggtcaggagttcaagaccagcctggccaatatggtacaaccttgtctctaccaaaaatacraaaattagccaggcgtggtggtgtgtacccagctacttgggaggctgaggaaggagaatagcttgaacctgggaagccgaggttgcagtaagccaaggtcgcgccattgcactagagcctgggcatcacaccaagactctgtctcaaaaaaaaaaaaaaaagtatcacttcacacctattataataaaaaaatcaagtaacaagtttggtgagggggtgaagtcaggaccaacatatactgtttagtgagatttgaaagtggtgcagccactttttaaaacagtctggcagttcttcaaa

SEQ ID NO: 206883 - DNA, 601 bp, Human
aagaagaatacacagaaataaatcttcatacactttgattaggcattagtttctctgacaccaaaagcacattaaaaaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaaataccaactgggcatggtggctcacacctgtaatcccagcactttgggaggccaaggygggcagatgacttgaggtcaggagttcaagaccagcctggccaatatggtacaaccttgtctctaccaaaaatacaaaaattagccaggcgtggtggtgtgtacccagctacttgggaggctgaggaaggagaatagcttgaacctgggaagccgaggttgcagtaagccaaggtcgcgccattgcactagagcctgggcatcacaccaagactctgtctcaaaaaaaaaaaaaaaagtatcacttcacacctattataataaaaaaatcaagtaacaagtttggtgagggggtgaagtc

SEQ ID NO: 206884 - DNA, 601 bp, Human
agaactgagtccagaaataaagccttaaatttatggtcaagaggctttttaaaatgtatttattttttcagagacagggtttcgctatgttgcccaggctggaccccaagtcctgagctcaagcgaccttcccatctcagcttctcagtagctgagaatacaggcacgtgccactgcgcctggctataatagatttttttacaaagacaattcaacgtggaaaaaatagtcttttcaacaaacagtgtgggacaactggataaacacatgcaaaagaatgatgacctcacatcatatacayaaattaattcataatggatcaaagacctaaatgtaagatatgaaactacaaaacactaagaagaatacacagaaataaatcttcatacactttgattaggcattagtttctctgacaccaaaagcacattaaaaaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaa

SEQ ID NO: 206885 - DNA, 601 bp, Human
ccaaattaatatggcgatacaatgcaatcattgtcaaaaatctcagctagcttctttgcagaaactgacacactgaccccaaaattcatatggaaactaaagggactaggagtagataaacagccttgaaaaggacaaagtcagaggactcacactcccgaattcaaaacttattacaaaactacgtaatggcatcagactaaacatatcaatggaatagaactgagtccagaaataaagccttaaatttatggtcaagaggctttttaaaatgtatttattttttcagagacagggtttmgctatgttgcccaggctggaccccaagtcctgagctcaagcgaccttcccatctcagcttctcagtagctgagaatacaggcacgtgccactgcgcctggctataatagatttttttacaaagacaattcaacgtggaaaaaatagtcttttcaacaaacagtgtgggacaactggataaacacatgcaaaagaatgatgacctcacatcatatacataaattaattcataatggatcaaagacctaaatgtaagatatgaaactacaaaacactaagaagaatacacagaaataaatct

SEQ ID NO: 206886 - DNA, 601 bp, Human
taaagtccaggcgttctacccatgagtctttaagtctttgattgacagtgggagaaacacacacctgatgtcctggaggaatggtataccctgccacagtctataaacaaaagccacacatttcattagagaatttaaaaatgtgctgacaaataatcagatcattgtgtaataaagcatgaatatacatgggatactcagatgctccttgacttatgataggtttacatcctgataaatccatcataaagtcaaaaaattataagttgaatcacataaatcaagaaccatctgtacatayatttaaaaactggctagataataggcaaactaaaaattattttaactcaagatgatttccagtgagccagcgttgggttggaagtacacagtacacaaatcaaacccataatgccttggaggtagggttggaatttcagagaggctttcactatcaatttgtacacttcatattaacaattttttacaacaaaatgttatttttaaaaccaagaaaaatatgtactttgatttttaaaaccccaattgttaaagaaaaatgcagaacatgattagcattaaagattagcatgtaggccgg

SEQ ID NO: 206887 - DNA, 601 bp, Human
attcgagaccagcctggccaacatggcaaaacccagtctctactaaaagctcaaaaattagctgagcgtggtggtacacacctgtaatcccagctactcaggaggctaaggcacgagaattacttgaacccagaggtggaggttgcagtgagctgagagattgtgccactgcactccagactgggtgacagagcaagactctctcaaaaaaaaaactatgattcttttatatattgtgttatacaccacagtattaaatttattacataaagttaagatctgaagttcccaaaggactttrtattttcctttatatgtggaaaaagtgtgaccaatgacaagtcatctgtcatttaaatgatccctttggaaagactaaagcatagaatatagtttaatcagtacagagaaccaatggacagagaaattactggagaaacaagggtatagctaaattattttaggatcttactggaaatgaaatttgcaagcctacacacaacctgcccaaatttaaagaccattttctcatacggatattcagagagcaaaaatgttgactaacgatcgagaagagctttaattttaaaagactgccttt

SEQ ID NO: 206888 - DNA, 601 bp, Human
tagaatgagccatcataaaaggtaactgaacaacccacaacccatttctagtaaagttcaagtggaaaccagataattactagtttagaaacgattcctctttggggcagaatttgggctacagaactaatgctcttcccatctgttaacaatctgattctttggccaggtggcatggctcacgcctgtaatcccagcactgtgggaggccaaggtgggcagattgcttcaagcctggaattcgagaccagcctggccaacatggcaaaacccagtctctactaaaagctcaaaaattagstgagcgtggtggtacacacctgtaatcccagctactcaggaggctaaggcacgagaattacttgaacccagaggtggaggttgcagtgagctgagagattgtgccactgcactccagactgggtgacagagcaagactctctcaaaaaaaaaactatgattcttttatatattgtgttatacaccacagtattaaatttattacataaagttaagatctgaagttcccaaaggactttatattttcctttatatgtggaaaaagtgtgaccaatgacaagtcatctgtcatttaaatgat

SEQ ID NO: 206889 - DNA, 601 bp, Human
gagaagaacaggagaatatcttcatgactcaggggctaagcaaaaattttaagacagggccagaaagcaataaccatttaaaagattgatacattggactaaactaaaggttattcatttgtcaaaactcaatgaatgttgacttaagatttgggcatttcattgcaagatttttcatcaaaagaaaaaacctaaactgatagtgcttagcacagtgcttgcttggcccataactgtacttatttctaggagtgacatttaagatgagcatttacaaattggtccatatttcaaatataasaactaaagagaagcttggcttacaggaagaatagtccaaggatttaatcgcaacaagcaagaagtatcctaattgaatcaacataagagtagataaattctgatgattcacaaaatgtaatattatgaaaatgaatgaactatatgcaccaacataaataaacagcacaattacgaggtaaaagaatgagtaaagaaattagagacatgtaatgtgatatttaacaagattaacgtaagatcatatatccccccataaattcaagtccatccagaaccttagaatgtgatcttaattggg

SEQ ID NO: 206890 - DNA, 601 bp, Human
aacttccagtaaagataagcataacataatcccaatacaaaacaagagaaactgcaaaacaagagaaactgcaagggtgaataagtgaccttgtactctacagtgacatttactagtcattaagtatcctactatatgacctggcaatgcctaaggacactaacagtacgttccccatagggcagaccttacaattctgaacattggcacatatacaatcatctaagatcaaaacagaaaactcctaaggcaaacaggtagagaaaaagtatttggaatgagaacagtcttgaaaagaagsactaacatttataataaaaaatgtattctttctaaaaagaaaagaataaatattccatttaccagcatgcataatgaatgggtgcccagtggtcactatctaactggttgactgaaaatctttcactgagaagacggcttagtaattctgaatctccttcacaggcgcttcggtggagaggaaaatcatctacccactgtcgttccctaatcattaaaaagaaattttgaaaaatacaacaggactgtaaaaattgtttcaaaagaaatgtgacacatctatgaaagctctgtatcacta

SEQ ID NO: 206891 - DNA, 601 bp, Human
gagcatatttttaaggaaacagaaaaaagatctttttatacacacacacacacacacacacacacacacacatataaagcaactatagttaactgcttgattacaaatattaaaatcagataaatcaaaagaatttcgagttggaagaaactctagaaatgatctactgcattttatatatggataaataagctgagatgcagagaggtaaagtgaattaccttgctcaatctaatacaactaagacactgtggacatttaacaaggcaataaataatgtggtacttttttttttttttttgaaatggaatctcactctgtcaccaggctggagtgcggtggtgcaatctcagctcactgtaatctctgcctccctggttcaagctattctcctgcctcagcctcccaagtagctgggattacaggcgtgcaccaccacgcccggctaatttttgtatttttagtggagacggggtttcaccatgttagccaggatggtcttgatctcctgacctcgtgatccacctgcctcggcctcccaaagtgctgggattacaggtgtgagccactgcacctggccggtacctcttaaattagccaa

SEQ ID NO: 206892 - DNA, 601 bp, Human
atccaaagagatactcaacaaatacttattgcatagttgttggttaatgcctggagaggcttaggtaaatgggttatatctgttagtataaaccctttatcctttatttgttggtataaatctttttatttcaaacagtttttaaactaatgacagccaggagcggtggcacgtctgtagtcccagctactcaagaggctgaggtgggaggacggcctaagcctagaaggttgaggctgcagtgcatcacgattgtctgtgaatagccactgtactccagcctgggcaacatagtgagacyctgtctcataaaaataaaaataattaaattaataatttttataatcattataactcttaggcataattgagtttcttctcattgttaattcttctgtattttaatgtcactaatttgagctttatgcctctaaataaaattattattttaatagctatgtatgccagcattttcgatttatgagtttatttccagttgtaattagatggaaaggccaggttgagttagcagaataaaaaagcttggaaacacctattttacttttatgaggaggaaaatgagtctgttatatataaacta

SEQ ID NO: 206893 - DNA, 601 bp, Human
agatactttccttcaacttcatgtgctttattatagatttctaacatgaaaaatatcagaaacactgttttaagtgagaatctgttggtgatattttaaaaacattttactggccgggcgcggtggctcacgcctataatcccaacactttgggaggccgaggcgggcggatcacgaagtcaggagctcgagaccatcctggctaacatggtgaaaccccgtctctactaaaaatacaaaaaaaaaaaaaaaaaaaaaattagctgggcgtggtggcaggcacctgtagtcccagctactmaggaggctgaggcgtgagaatggcgtgaaccccgggaggagcttgcagtgagctgagattgcgcgactgcactccagcctgggtgacagagcaagactccatctcaaaaaaaaaaaaaaaaaaaattttacttccattacttgtattttctaaaatattttcttctggatgttccagaaataagtttagtaaactaaggagaatgacttaaaaacatactcaatgtcaaattcttttgacaggatgttttagcgcctttaatgtaatgtaaatatcataacgagagatacaaacttggtt

SEQ ID NO: 206894 - DNA, 601 bp, Human
caatttctatacatttttaccagctcattattttctgttttgttttttatagccatcctagtgggtgtggtttctcactgaggttttaatttgcatttccctaataactaatgatgctgagcatcttttcatgtgtttgctggctatttatatattcaagtccttcgacctattttatttacagacagggtcttgctctttcatccagcctagagtacagtggatgatcataactaactgtagccttgaactcctgggttcaagagatcctcctgtctcactctcctgagtagctagaacyacaggtgtgtgccaccacgccaggctattaaaaaaaaacaaagacaaagacaaaaacaaaaacaaaacttttttgtagagacagggtctcactatgcagccaggctggtctcaaattcctggcctcaagtgagcctcccacctcatccttccaaagcactgggattacagaagtgaaccaccacgcctggcctactttttttttttttttgagatagtcttgctctattacccaggctggtgtgcagtcgtgcaatactggctcattgtaacctctccctcccagactcaagcaaccttc

SEQ ID NO: 206895 - DNA, 601 bp, Human
aacaggaatttcttaattatataatgagtgaaagaacacaactgccttaccagattatcatgacattctggtttaccataagaacttactaagccttgcttcctttttacttgagtctcctttattttataattatgcaatttatttatcacccaagtattatcattactgctcctcttctctaccagtgaactattacaatattacttgggaggagaaggcagactgagtatacttagattatatgcagattttatagctatcatacattttttaagttatagggtaaaacagatataayatttgtcatttgacccgttttaaagtgtgaaattcagtggcattaattatgttcacaacattgtgctaccatcactactatctagttccacatagtttatatcatcccaaagagaaattctgctaactggtaagaacttcccacccctcccctagcccagcacctctgataacctccaatctattttttccctttatgcctttgcctattctagattacttgatataagtagaattaaatatttgttcttttgtgtctggtttatttagtatgttttcaaggttcactcatgttgtcaca

SEQ ID NO: 206896 - DNA, 601 bp, Human
tacagaatatattcctacttgtacaaagtcaccggttataaagtttctgaataaatacttaaagtatttccaaatacaattcacaacgatcccaagcttgaataaaaatgatttttgcggccaggcacggtggctcacgcctgtaatcctagcactttgggaggccgaggtgggcggatcacgaggccaggagatcgagaccatgctggctaacacggtgaaaccccgtctctactaaaaatacaaaaaattagctaggcatggtggcaggcgcctgtagtcccagctactcgggaggctsaggcaggagaatggtgtgaacccgggaggcggagcttgcagtgagccgaaattgcaccagtgcactccagcctgggtgacagaaagagactccatctcaaaaaaaaaaaaaaaagatttttgcaacattaactgaaataatactatttttctatcttaaaatactctatattattaaatattaataatactctatttaaaattaattaaaatactctattattaaatattaaaaaaaaaatttcatggggaaaaaatgaaggggactgttctaaattaaaagagactgaagagacatcca

SEQ ID NO: 206897 - DNA, 601 bp, Human
tataaatatggataatttttagcaaaattttacctaaatttttgtatgactgaaacatttttctattaactatgcttcatacaatacagtagtggacttcaaagaagataaaaggaagtatcttaatttccaaaggacaaatgcatttttaaaaagcctgttgtaagacattttaaattttgactaaaaagactttgcactttcaaatattaataatattcaagaagagtaaatttttgttttgttttttgagacagggtcttgctctgccagccaggctggagtgcagtggcatgaacakggcccactgcagcctcgacctcgtgggctcaagctatctacctgcctcagtctcccaagtagctgggaaaagaggtgtgcaacaccatgcctggctaatttttaaattttttgaagacagaaggtcttgccatgttgcctaggctgggctcaagcagtcctctcaccttggcctcccaaagtgttgggactacaggtgttagccactgcacctggcctagatctttttttttttttttaaaactataaagtttatccaataagattaataaagatttgagaaatcctagcctacagaata

SEQ ID NO: 206898 - DNA, 601 bp, Human
aatgtatcttgcagatcattctacacaaaaatactctttattcttttttatggctgaagggtattctaatgcagaaatgtaatataatattaacgccttactgacagtgatttagtgtcccccttcctcttatgtaatgaatgagttgcaatgaacagtcttgtatatatgccatttctaaattcttcatgtaggttggtactgttgttttaactattatatgacatgattggtaaaaaagagctgaaaatctaccttagtttccatgttgaggagatgaagtccttttatattcactccyacatacacagggatgactttatgattgctggggcttgcctttgtaaatatctgtcctgtgaaaaatgctgctccataagtaggaatttcccagcaattctgtaagaacatgcgctgaaggtgatgcatttctttactgacaccttcacttgtactgagattctaaaaacaaacaaggtaaattaaaaataaaagagatatgaaaggaaaatgtaccattgataatccaaatagatcaactaagcagtttctaaaatcaagattgcccctaaagaataaaattatggcacattgtatcagg

SEQ ID NO: 206899 - DNA, 601 bp, Human
aaaacagtatagaggtttctcaaaaactaaaaataaaactaccatatgaaccagcaatctcactactgagtattcttccaaaggaaaggaaatcagtgggatcctgcaaccccatgttgactgcagcactattcacaatagcaaagatatggaatcaacctaagtgtctcccaacagatgaatgaataaagaaaacgtggtatatatgcacaatgaaatattattcagccataaaaaagaatgaaatcttgcattcgcaacaacatgaatggaattggaggtcattttgttaagtgaaatyagccaggcacagaaagtcaaataccctatgttctcatatacgtgagacgttgatgtcaaggaggtagagagttgaatgatgattaccagagctgggaagggtagggtagggtaggaataaggagagggtcagttaacgggtacaaacatacagttagatagaatgaataagttgccgtgtttcatagtacactagggtgactatagttaataatttattgtatatttcaaaatagctaagagataagttgaaatgttcccaatacaaagaaatgataaatatttaaggtgatgaatttcc

SEQ ID NO: 206900 - DNA, 601 bp, Human
agaaagcaatctcatttactatagctagtaaaaaaaatcaaataattgagaataaatctaactaaaaaactgaaagacctctgtaatgaaaactacaaaacactgatgcaagaaattcaagagcacacaaaaaattggaaagatatccatgctcatggattggaagagttaatattgttaaaatagcaatataggccaggcatggtggctcatgcctgtaatcccagcactctgggaggccgaggtgggtggatcacctgaggtcagaagttcaagaccagcctggccaacatagtgaaaycctgtctctactaaaaatacaaaagaaaaaaaaaattagctgggcatggtggtgcaagcctgtaatcccagctacttgggaggccgaggcaggaaaactgcttgaacccaagaggtagaggttgcagtgagccgagatcacgccaccgcactccagcctgggtgatgaagcaagactctatctcaaaatcaatcaatcaatcaataaaaataaaacagcaatattacccaaagcaatcaagtaattcaatgcaatctttattgaaataccaatgacatgctttacagaaataaaaaaaaa

SEQ ID NO: 206901 - DNA, 601 bp, Human
gataaaacaaattcaataaagttgcaggacacaaaattcacatacaaaaataagtggcatttctatacaccgataatgaaccagctgaaaaagaaatcaagaaagcaatctcatttactatagctagtaaaaaaaatcaaataattgagaataaatctaactaaaaaactgaaagacctctgtaatgaaaactacaaaacactgatgcaagaaattcaagagcacacaaaaaattggaaagatatccatgctcatggattggaagagttaatattgttaaaatagcaatataggccaggcrtggtggctcatgcctgtaatcccagcactctgggaggccgaggtgggtggatcacctgaggtcagaagttcaagaccagcctggccaacatagtgaaaccctgtctctactaaaaatacaaaagaaaaaaaaaattagctgggcatggtggtgcaagcctgtaatcccagctacttgggaggccgaggcaggaaaactgcttgaacccaagaggtagaggttgcagtgagccgagatcacgccaccgcactccagcctgggtgatgaagcaagactctatctcaaaatcaatcaatcaat

SEQ ID NO: 206902 - DNA, 601 bp, Human
tgttaaatatgccaaaaaataactgataaacctgtattttataatgacttacggttagaaaaaggagcaccataaactaacttctaactgaagagctctaaagtgggattgaaaagggtctaacccacctactgctgctgtcacctgtgcacatagtgccaggaggtcaacccacctgcctgccaccagcacctgcaaactccagaggtgggcttggagagaagcctgccctgcccaccactgccaccagcacacattatctagggtcctaaggacaagcctgctctgcccactgccactrtcaactgtgcctaagcatgccatctaagggcctgaggactgactcaactagcacgctgctgccattgcctgcatacaccatcagagggcctgacgacaggcctgttctgcctgctgttggtgcctgtgcatttcatctggggccttaagtactgttatgctctgcctatgcctgctggcgcccacatgtactatctaggggcctgaggaaaggcatgccctgcctactggcacaactactagtgcctgagcactggtctacctggagtcacagtccccagaaaagcctactacagccttc

SEQ ID NO: 206903 - DNA, 601 bp, Human
aatacacatgaagttataccaaagctacattttaatctcatcacattccaccccaaattccttaccatttaccaaaaataactttttataaagcttactattttgtctaatattatacagactatcaatctataactttttgtgtttctctcaaaaattagaatagcttatgaggatattatataaaactaattggtatattacacaccaaacataagtacagattctgtacaatgtaatagtatacatatatattacaagagactatatgccttgttgaaagtaatttttttttttttttgagatggagtcttgctgtgtcacccaggctagcgtgccgtggtgcaatcttggctcactacaacctccacctcctgggtttaagcgatctcccaccttggcctccctagtagctaggattataggcgcccgccaccacacccagctaatttttgtatttttgtagagacagggtttcaccatgttggccaggctggtcttgaactctgacttcaggtgatccgcctgccccagcctcccaaagtgctggaattacaggggtgagccaccatgctcggccaaaagtaatattttaagaaat

SEQ ID NO: 206904 - DNA, 601 bp, Human
gcctaccttctttaaactgtccccatcccacttcccccagaaaggatattcagttttttatggcacctctccccaaaagcacatagaaataacatttggttctgttcccattagggttggttgagaaaggactttgaagctatggaataaaagtcgcgctagcgcactgcagcttcaattcctggtctcaagcgagcctcccgcctcaacctccggagtaactgggactaccggcccaagccactacacctggccaaggaagtaacccttaattaatagttcatgatgttattttcctttrcaactcggggtaacaaatacaaaatttaatataagatgtgagcattttaactccattttaagagaggtgtccagtgtggttggactaaagcccctttctcgtaagcatccacaattcctcattcctgcacatctcctcccttgggaccatacataaaaactcaactcctcatcttgggcacctgaaaatctactttaacagagaaagcgctctagatggcaggtgtccttagagctgggagcgaagcccaagcaagaactaaagagggtggctgactccacaaagccacccccacaaccc

SEQ ID NO: 206905 - DNA, 601 bp, Human
acaacctgcagcatcctgtccaggaacccaaaccattatttagaataaccaggccaggaggccagccggctataagccagacttgaaggaaatcagactgctatctctagtgacagtccaggaagcaaaacaataacccctttaacaatcagcccaaaatggctaggacttttttttcttttttttttttttttttgagatgaagtctcactctgttgtctgggctggagtgcagtggcatgaactcagctcactgcaacctttgcctcccaggttcaagtgattctcctgcctcagcctycccagtagctgggattacaggcacgtgccatgatgcctggctaattttttgtatttttagtacagacggggtttcaccatgttagccagcatggtcttgatttcctgacctcgtgatctgcccacctcggcctcccaaagcactgggattacaggcgtgagtcactgcgcccagctgcaaaatggttaggatttgattactaactgacagcttccgtaatttctgtccttgattccaacttaggacaaccagagaaaaccaaatacacacccctaacccataccatagaatgttgtgctt

SEQ ID NO: 206906 - DNA, 601 bp, Human
tcttacaacatcattgtgagaattgagagaccaaatatacagacaatgactagtccttatataaaacagaactctgacccacaacctgcagcatcctgtccaggaacccaaaccattatttagaataaccaggccaggaggccagccggctataagccagacttgaaggaaatcagactgctatctctagtgacagtccaggaagcaaaacaataacccctttaacaatcagcccaaaatggctaggacttttttttcttttttttttttttttttgagatgaagtctcactctgttgtcygggctggagtgcagtggcatgaactcagctcactgcaacctttgcctcccaggttcaagtgattctcctgcctcagccttcccagtagctgggattacaggcacgtgccatgatgcctggctaattttttgtatttttagtacagacggggtttcaccatgttagccagcatggtcttgatttcctgacctcgtgatctgcccacctcggcctcccaaagcactgggattacaggcgtgagtcactgcgcccagctgcaaaatggttaggatttgattactaactgacagcttccgtaat

SEQ ID NO: 206907 - DNA, 601 bp, Human
ctgaagtcaatatcctcatatgtcaaataatgtctatcttacaacatcattgtgagaattgagagaccaaatatacagacaatgactagtccttatataaaacagaactctgacccacaacctgcagcatcctgtccaggaacccaaaccattatttagaataaccaggccaggaggccagccggctataagccagacttgaaggaaatcagactgctatctctagtgacagtccaggaagcaaaacaataacccctttaacaatcagcccaaaatggctaggacttttttttcttttttytttttttttttgagatgaagtctcactctgttgtctgggctggagtgcagtggcatgaactcagctcactgcaacctttgcctcccaggttcaagtgattctcctgcctcagccttcccagtagctgggattacaggcacgtgccatgatgcctggctaattttttgtatttttagtacagacggggtttcaccatgttagccagcatggtcttgatttcctgacctcgtgatctgcccacctcggcctcccaaagcactgggattacaggcgtgagtcactgcgcccagctgcaaaatg

SEQ ID NO: 206908 - DNA, 601 bp, Human
ctgctgaagtcaatatcctcatatgtcaaataatgtctatcttacaacatcattgtgagaattgagagaccaaatatacagacaatgactagtccttatataaaacagaactctgacccacaacctgcagcatcctgtccaggaacccaaaccattatttagaataaccaggccaggaggccagccggctataagccagacttgaaggaaatcagactgctatctctagtgacagtccaggaagcaaaacaataacccctttaacaatcagcccaaaatggctaggacttttttttctttyttttttttttttttgagatgaagtctcactctgttgtctgggctggagtgcagtggcatgaactcagctcactgcaacctttgcctcccaggttcaagtgattctcctgcctcagccttcccagtagctgggattacaggcacgtgccatgatgcctggctaattttttgtatttttagtacagacggggtttcaccatgttagccagcatggtcttgatttcctgacctcgtgatctgcccacctcggcctcccaaagcactgggattacaggcgtgagtcactgcgcccagctgcaaa

SEQ ID NO: 206909 - DNA, 601 bp, Human
taggtaagcacagagaaagtgtgtgtgtatacatatctacatctctagaggaagggaatcgcgtgggaaggcttcctggaagaagcctactctgagctgaatgctcaaagttaacctgctgaagtcaatatcctcatatgtcaaataatgtctatcttacaacatcattgtgagaattgagagaccaaatatacagacaatgactagtccttatataaaacagaactctgacccacaacctgcagcatcctgtccaggaacccaaaccattatttagaataaccaggccaggaggccagcyggctataagccagacttgaaggaaatcagactgctatctctagtgacagtccaggaagcaaaacaataacccctttaacaatcagcccaaaatggctaggacttttttttcttttttttttttttttttgagatgaagtctcactctgttgtctgggctggagtgcagtggcatgaactcagctcactgcaacctttgcctcccaggttcaagtgattctcctgcctcagccttcccagtagctgggattacaggcacgtgccatgatgcctggctaattttttgtatttttagtacaga

SEQ ID NO: 206910 - DNA, 601 bp, Human
tggaggacgtaggcaaacaggcaattacaacctaatgttgtgacagggtagagaaaagcactggatctggagtcagactgcctggatgagaagcatagctccaccacttccatgtgaccttggccaaggggataataatgaaataatgatccctacctcacagtactgtgaaagatgaaattagttattatatatgaagcatttagaacactggtgtggcatgtaggtatctaagtatttattattatgatggtgatgatgatgcagtataggtaagcacagagaaagtgtgtgtgtatayatatctacatctctagaggaagggaatcgcgtgggaaggcttcctggaagaagcctactctgagctgaatgctcaaagttaacctgctgaagtcaatatcctcatatgtcaaataatgtctatcttacaacatcattgtgagaattgagagaccaaatatacagacaatgactagtccttatataaaacagaactctgacccacaacctgcagcatcctgtccaggaacccaaaccattatttagaataaccaggccaggaggccagccggctataagccagacttgaaggaaatcagac

SEQ ID NO: 206911 - DNA, 601 bp, Human
gcaccagaaggtacaggtagaaaagtaggctgtgtcgatgaggttagactttctctgtgggcaatgagaagtccttgaagattttgcacagagacatgctacattcagttgaggttttagagactaattgaagcagcagtgtgtagcaggaagtggaaagtgaagataccaaaaggatggggaaaacccattgaaaagccactatgctaatctaggtaagagataatgggggtcctaaattagagcagtggcaatggaaataaggaagaaaaaccaaagatcaatctctctgtctctctcycttttttcttaagactggtcaagcgaagcagtggaatagaaaaggaacagagaaatctgtggttgtgatcaattagttgtaaacaccactgcacaaaaaccagccaaaccaaagatctcttgtgtgagtcatccttttaacaatcttgtcaaaagacagcaggtccaggccgggagcggtggctcatgcctgcaatcccagcactttggaaggccaaggtgggtgcatcctgtgaggtcaggagttcaagaccagcttggccaacatggtgaaacactgcctctaccaaaaatacaaaaa

SEQ ID NO: 206912 - DNA, 601 bp, Human
aaaagaggtggccaggcgcggtggctcatgcctgtaatcccagcactttgggaggccgaggcaggtggatcacgaggtcaggaaatcgagaccatcctggctaacacgatgaaaccccgtctctactaaaaatacaaaaaattagccagacatggtggtgggcgcctgtagtcccagctactcgggaggctgaggcaggagaatggcgtgaacccaggaggcacagctggcagtgagccgagatcatgccactgcattctagcctgggtgacagagcaagactccgtctcaaaaaaaaaaraaaaaaacaaacaaaggctgaggcaggagaatcacacaggaggcagaggttgcagtgagccaagataactccattgcactccagcctaggggacaagggtgaaactctgtctcaaaaaacaaacaaacaaacaaacaaaaaacacagcactcaacgaaccaggaacagaagagaacttcctcaaccttataaaaggcatccatagaaaaaacaaaaacaaaaataaaataaaataaaaggcatccatgaataacctaagcaaacattctactcaatggtaaaggactcaatgcttttccc

SEQ ID NO: 206913 - DNA, 601 bp, Human
tcgtttgaacctgggaggcagaggttgcagtgagccgagattgcaccactgcactcccgcctagacaacaacagcgaaactgtctcaaaaaaattacgaattaaaataattcttatagaaggatatgataaaattttaagcaattctctgacctttatactctagagcaggggtttccaaccatcagatcacaaactggtactagtccatggcctgttaggaactgggcctcctgttaggaggagggaagtggctggccagtgagcgttatcaactgagctctgcctcctgtcaggtcagygatggcattagattctcataggagcacgaaccctattgtgacatgggcatgtgaggaatctaggttgtgcactccttatgagacttttttttttttttgagacagagttttgctcttgttgcccaagctggagtgcaatggtgccatttcggctcactgcaacttctgcctcccaggttcaagcaattctcctgtctcagcctccccattagctggtattacaggcgcatgccaccacgaccagctaaatttttgtatttttagtagaaacagggtttcaccatgttagccaggctggtc

SEQ ID NO: 206914 - DNA, 601 bp, Human
atacaaagctgcatacctgaaggagcagtgacagtcacctggtcaggtgtgctacatgaagcatatcaagtatcatacactcattacttagcattctagactaagcagagtcagtaagtcccacttcccgactactaatacagggtgtgcagaccacctacacatgccctttgaattaaaaataaaatttaatactccacagagtttaactattaaatagactcttaattttaggaaatttcacatttgtgggcaataacataatttgattacctggcctatagttgactaatcacacatmtcattgtttaacttgacctgaaaaatgcactgaggattttgcatctctttaagcatgaccctgaaaactgagaactaccataccacctttgattcttacatccaagaaaattgtcactaccccctaagtaatcaaaattcaacaaaagaaatgaagaggtcaggcgcggtggctcacgcctgtaatcccagcactttgggaggccaaggcgggtggatcacttgaggtcaggagttcgaaaccagcctggccaacatggtgaaaccctgtctctactaaaattaaaaattagccaagcgt

SEQ ID NO: 206915 - DNA, 601 bp, Human
ctctactaaaaatacaaaacttaggctgggagcagtggctcacgcctgtaatcccagcactttgggaggctgaagtgggtggatcacctgatcacctgaggtcaggggtttgagaccagcctgaccaatatggtaaaaccccatctctaacaaaaatacaaaaattagccaggtgtggtggcacatgcctgtaatcccagctacttggaaggctgagtcaggagaatcgcttgaacctgggaggcagaggttgcagtgagtcgggcgacaagtgagactcagtctcaaaaaaaaaaaaaaagaatcagagaagaccgactaaggtcaaataatgaatccctgctatatacaaagctgcatacctgaaggagcagtgacagtcacctggtcaggtgtgctacatgaagcatatcaagtatcatacactcattacttagcattctagactaagcagagtcagtaagtcccacttcccgactactaatacagggtgtgcagaccacctacacatgccctttgaattaaaaataaaatttaatactccacagagtttaactattaaatagactcttaattttaggaaatttcacatttgtgggca

SEQ ID NO: 206916 - DNA, 601 bp, Human
gtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgytttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacc

SEQ ID NO: 206917 - DNA, 601 bp, Human
ccggcccggtctcttgcctggcagctcgggtcgtcctcgtcctccagtgattgttttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcstcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccag

SEQ ID NO: 206918 - DNA, 601 bp, Human
tgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggccygggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtgggg

SEQ ID NO: 206919 - DNA, 601 bp, Human; identical to SEQ ID NO: 91540

SEQ ID NO: 206920 - DNA, 601 bp, Human; identical to SEQ ID NO: 91539

SEQ ID NO: 206921 - DNA, 601 bp, Human; identical to SEQ ID NO: 91538

SEQ ID NO: 206922 - DNA, 601 bp, Human; identical to SEQ ID NO: 91537

SEQ ID NO: 206923 - DNA, 601 bp, Human; identical to SEQ ID NO: 91536

SEQ ID NO: 206924 - DNA, 601 bp, Human; identical to SEQ ID NO: 91535

SEQ ID NO: 206925 - DNA, 601 bp, Human; identical to SEQ ID NO: 91534

SEQ ID NO: 206926 - DNA, 601 bp, Human; identical to SEQ ID NO: 91533

SEQ ID NO: 206927 - DNA, 601 bp, Human; identical to SEQ ID NO: 91532

SEQ ID NO: 206928 - DNA, 601 bp, Human; identical to SEQ ID NO: 91531

SEQ ID NO: 206929 - DNA, 489 bp, Human; identical to SEQ ID NO: 91530

SEQ ID NO: 206930 - DNA, 601 bp, Human
ctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcawaagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggcca

SEQ ID NO: 206931 - DNA, 601 bp, Human
ttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacrggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctg

SEQ ID NO: 206932 - DNA, 601 bp, Human
gaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcrcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaact

SEQ ID NO: 206933 - DNA, 601 bp, Human
ctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgcyagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgcc

SEQ ID NO: 206934 - DNA, 601 bp, Human
ggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcagkatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcga

SEQ ID NO: 206935 - DNA, 601 bp, Human
acataaagtatagaagtaaaagtgtaaaataatgtaggaagaaacactgtatttcaaaggtaatctttatgagtaaatgttaaataagttcagtaaagacagtttttaaaaacatggatctttaagtgaaaatttctcactgaaacttacccagtgttctcgacatcacaggcagagcagagctcaaaaccaagatggacacacaatttccaatgatctgttatgagaaacgagaaagaatattgggcagttaaacagcaggatgacaatcaaacccagtaacattctgagaaatgattgygcattctagttacctagtgtactttgccgatttcttaatgatactattcagtacagaattttcaaagaataacacacttttaaaataaataaagttatatctgtaagttctagaagatgtttacagtacctagcacagatatagttatagaatacttaaattacttgacacctagataatgcactttacattactgattgcagctgttactttcaaaaggctctgcctgtcaagcaaaaaataattaacatattggatacttctgactacatttttaaggccagattattgcttaagatc

SEQ ID NO: 206936 - DNA, 601 bp, Human
taaaagattatcaaattctccgtaaactgaaacaataagaaaatgacagaaatgaatgacaggcaagtaggaactctcaagggtgtcctttgaatcagagtgtgttctcagagattacactgcgttcacctctattttgtggacacaaagcagcttaaaataatttacaaattttcaattttttaaaccatactaaattataaacgctcaaaagcttttaaatagaaaaattagtttaatgcagtttcctcactagaggactcgaaagcctaacttatagatgtgtcagtaaaaacaaaayacaacaaaaaccagcccgttgtttggagaaagaatgcttttaagtgtttaaaaaataagtagtcattatttgataaaagtatttgtcttggtatgcccctatacataaagtatagaagtaaaagtgtaaaataatgtaggaagaaacactgtatttcaaaggtaatctttatgagtaaatgttaaataagttcagtaaagacagtttttaaaaacatggatctttaagtgaaaatttctcactgaaacttacccagtgttctcgacatcacaggcagagcagagctcaaaaccaagatgg

SEQ ID NO: 206937 - DNA, 601 bp, Human
attctagtcttataagcttttcagctggtaaatcaaaatcctgttatacactaggataatattcatgacaattccctatattttatcttcttaaaatcaaagactcaattctaaagggttaatagaggaattacaaagtaactctctagtttgcatttcccataatgctaaaataaagctttttcttttagtctagaaatttgcttttttaatactgtgaaaagcctctatgaatctgtttaacgtatttatttcttttcatctattcaatgccactgggcataacatgtaatgcagtgcrtgttgatattttgcaaagcaccacatgactcactgtaccctaatgcactccattaatcctgtttggacagctgggtccaggcatttgttagctgcattttaattgttccatctttcttttttttctttttatttatctctatggcaaactactctggaatttaatttgttggccttcaaaaagtaaattttaccattagtttgttttctttgtgttaaaactatactcagcatgtaattttcttccataaaatcggtatatattaatgattagcaatcaatcttaaataatagtacagtg

SEQ ID NO: 206938 - DNA, 601 bp, Human
aaaccatcatttatactaattctacttaaccaagaatacatggtcaaaatttttctcacaacttaattctttgtggcaagaaatatgcttataaaatttacttagtggtgatttttcagttagtacaaaatttttcattcaaatataacaagctatttaaaaggaattatttaataaatatgtcatatcacaccatgtacttaaatctaaagcctgcgatgcatcaacaataatagtgggcaaatgtttaaaaaagaaacatgtccattgaacactttcatttttgaagcaaaaacatcaycaaattatttcttttatactagattcgatgtatttcaagttataatcaaatttatattcttcactaaaaaaactgttgaaataatagagaaattacatatatagagataaaatatgatttttcttgttactgcatttctcattccattgtaagtgatgggacgctgctggctgatttcacaggagcaaaggagaccacactaaggtcagggtttccttgagagaggcgacaagaaagactgaaaaatgtcacagcttggaatctgattgcttaaatacatcctctattctagtcttataa

SEQ ID NO: 206939 - DNA, 601 bp, Human
tatctgaatataataaaatcatatatactttttggtgagaaattttcaatatagggtttgaaattatttttatatcaatgtcataattaggaatatatgacttatacttccatttcacatttgtcattgctaagcctctgtgaaagcattgtttatttctgtttcacaacaagagctagagaaagcccagggtacagataaatagggattaccaaaaccccaaataaagacctctccaaaaaagacccgttataaaacaaggtcccttcatcaagaagcaaaaaggaataatctactttamctcctgtaagataatagactatatgggacccaaatgagaaatatgtgaaaatactgaaaataaattcaagctgatttgaaagagtaagtgtttttgttttactaccataagtacattaaaaacaaattgtatttggacactaaataacttacaaattatagaaagagcttccaagatgaaaaataactgtaaaaataattacaatatagaaattattaaaagcatttcaaagactatcatttgcatttgagaaaaattttcctctttaaaggagaattcaaataaagaataacacaaaaa

SEQ ID NO: 206940 - DNA, 601 bp, Human
aacataaagtttcatgagaaagtcaatacagacaggtacgtataatacaaggttgaaagtgcaagactctgagacaccttcacgtgtgatgcaggatttgactctgcctcagagaataaaaaagatttggatagatagagaaaggtgaatgggagaagactgtgggaacaatgggaaccaaagcttagagatggaaaactgtatttgcaaatatcgaatcaattttagtcatgaggatttacgtgcaacaatttcattttgttctaatctggaggcaaattaaatttagtcgtccagaacyagagtatgtgaacttgaagacagactaaaatccaatgaaagagaattataattagagtccaggaaagaaccttatgtgctaattttcaaagaagtgcacgcctaagccctccagcatggatggtaactggctgcgatcttcctgaggaaagttctccagagacaggtctccatggtatggctcagtcaaactttctcacttggaaaattaaatatgtccttatttcttttggtttggtttgatgtcttctttctctatccttctcaaataaaaggacatccgcttagaatctacttcaca

SEQ ID NO: 206941 - DNA, 601 bp, Human
gaactagcccttaaataacaagtagactctgaatggaaagaagggacaaaggaggtgccccaggttaggactctatacaccagaaaggcgactttcaaaagtccttccacctgcctccccttatcaagtgcctggcactaagaaggcaaatgcaaacacataaagactgacttactaaaaacaattaggccctggcattagactgccacgccaaggaaacggagaagaggacaaatatttactgagtatctactgagtaaaagacttataaaaaaatacttttttctttttttttttttttgagacagagtctcgctctgtcacccaggctggagtgcagtggcacgatctcaggtcactgtagcctctgctgcctgggttcaagtgattctcctgcctcatccttccaagtagctgggattacaggcgcacgctaccacacttggctaatttttatatttttagtagagatggggtttcacgatgttggccaggctggtctggaactactggcatcaagtgacctgcccgcttcggcctcccaaagtgctgggattacaggtgtaagccaccacacccagccaaaaaataacttattgaa

SEQ ID NO: 206942 - DNA, 601 bp, Human
aaggaatgcaaacaactcaacaacaataacaaaaatgacttcattaaaaagtgagcaaaggacacacttcaaaaagtgggcaaaagacagacttcaaaagaggtcatacaaatggccaactagcatatgaaaaaatgctccacatcactaatcagagaaatgcaaattaagaacacaatgtgatattatcttacatcagtcagaatggctactattaaaaagtaaaaaaaaacaacaaatgttggagaggatgcagaaaaaagggaacacttctatacggttggtgggaatgtaaattatyacaacctctatggaaaaacagtatggagatttctcaaagaactgaaaatagaactaccatctgatccagcaatcccagtactgggtatctacccaaaggaaaagaaatcattatatcaaaaagatgcctgcactcatatgtttatagcagcactgatcacaatagcaaagatatggaatcaacctaagcgccaatcaatggacaactggataaagaaaatgtggtataaaaacacaatggaatacaattcagccagagcaaagaatgaaatcatgtatttcacaacaacatgggtggaat

SEQ ID NO: 206943 - DNA, 601 bp, Human
agcatgaatagccaaagcaatcctaaggaaaaagaacaaaactggaggcatcaacttacctaacttcaaattatacaacaaggatacagtaaccataagagtatggtactagtataaaaacagacacagatcaatggaacagaatggagaacccaaaaataaagccacgtatttacagccagctgatctttgacaaaactgacaaaaacatacaatgaaaaaaggatacccttttcaataaaaggtgctggtaaaattggattgccatatgcagataaaagaaactggacccctatctctygccatatataaaaatcaactcaagatggattaaagactgaaatgtaagacctgaaattataaaaatactagaagaaaacctaggaaaactcttctggacattggtctaggaaaagaattcatgacttaagacctcgaaagcacagacgactaaagcaaaaataaacaaatggaacttaattaaactaaaaagcttctgcacagcaaaatatcaacagagtgaacagataacctgcagaatgggagaaaaagtttgcaaatgatgcatccaacagcagactgatatccagaatttacaagg

SEQ ID NO: 206944 - DNA, 601 bp, Human
gtgtgtgaggtggggaaaaccttcctctgaacacacatcctcactgtggtagctgaaaatccagataatgggaaaaggatttaaccttacttagagttgaaatagattcagggagccacacaaaaaataaaagcagcatcagtggcaggaagagccctgtaggctctcccagtctccagctcaagcccagggaagccatccctgactatatctcacaggggaccttggggaaggcagccagtggaattagggtggggttacaggatgaaagaagcttccaactgaaatttgtaataacttggggcacaaattttcttgagcagaatttcttgagcaaattttcttgagcagaatctggtaggggggcagggtgcaaatgggaactgctgcagataagagcacagaagccaccacggacagtgtgggcagatggggaagggcaaagcctgaaagccatgcttgctttctcagcggggaagcttacggcctgggacaaggtctgcggcagggactgcagaagagagaccagccttgccaactgtgtgggagctggatgaggcctttcactactggctctccccaacttccctggcaaactata

SEQ ID NO: 206945 - DNA, 601 bp, Human
caagaggatataacaatacatccaaatatacatgcagccaacagcaccaagattcataaaacaaatattactacagctaaagaaagaggcagacagcaatgaaataatggtggtggacttcaacaccctattcatagcttatcgagaaaaaaaatcagcaaagaaacactgtacttggtgcaacggacctaaaacacatttacagaatattctgctcaactgcagaatttatgttctactcatcagcacataaaacgttctccaagataaaccatatgttaaaacacaaaacaagtctcarcaaatttttaaaaatcaaaaattttcatgcatcaatatcacgaaatcaataccaagaagaatttcagaaaacatacaagtacacagaaattaacaacatgcctctgaatgaccattgggtcaaagaataaattaagtcagaaattaaaaaaaaaatttttgaaacaaatgaaaatggaaacacaacatactgaaacttgcgagatacagcaaaaacagtgctaggagggaagtttatgacatcaagtgactacatgaaagatactgaaagatacaaattaacaacctaatgtcatacctc

SEQ ID NO: 206946 - DNA, 601 bp, Human
aagaacttacaaaactagaaaacaatgaaaaaatatgacaggaacaaaacctcacatatcaatattaaccttgaatataaatggattaaattctcctcttaaaagatacagattggtggaatggatagagaaaaacatgatccaaccatacactgctcacaagaaatccaccttacctatgaagacacagcctcaaagtaaagatattccacacaaacaaaaaaacaaacaagaccaggagtagttatactgacaccagataaaacagactttaaatcaaaaacagttaaaaaaaaaaaaagacaacaaaggtcattatataatgataaagggacctattcagcaagaggatataacaatacatccaaatatacatgcagccaacagcaccaagattcataaaacaaatattactacagctaaagaaagaggcagacagcaatgaaataatggtggtggacttcaacaccctattcatagcttatcgagaaaaaaaatcagcaaagaaacactgtacttggtgcaacggacctaaaacacatttacagaatattctgctcaactgcagaatttatgttctactcatcagcacataaaacgt

SEQ ID NO: 206947 - DNA, 601 bp, Human
aaagccaaggcaatatgacaccctcaaaggaaaacaataattctccagcaatagatcctaactgaaaaaaaaaaaccctcaaaatgccagattaaagctcaaaatactaatttcaaacaagctcaatgagatgtaagagaaatctgaaaaccagtacaaagatcagaaatcaatataggatgtgaataagaagtttactaaggaaatagttgtctttaaaaaaaaaaaaaaccagaaattctgaaacaaaaaaattaatataaggaagtataaaatataatcaaaagcctcaacaatagaycaatagaagaaagaatctcagaacgtgaaagacaggtcttttgaaataatccaggcagacaaaaataaagaaaaaggaacaaaaaagaatgaagccttggagatgtttgagactacataaaaacctaacgtacaaattcctgagggggaagaaagatcaaaaagtttagaaaacatatctaataaaataaatggtgaaaagatcccaagtatagcaagagatttagacatccaaatacaggaggtccagtggtccatgaaaaatacactgcacaaaggacttcaccacagcatattataa

SEQ ID NO: 206948 - DNA, 601 bp, Human
tggaaaagaggctgggcacaaatcctgttgtacccactgtagctggctctaacctgtaaacatcgcctactgacctagaggtcaacatgcaaagcccactgcaacaacttctaacacaagggcaaagtgcttggaaactagaagatcattgcacaaccactgctaccaccatgacccatgccaccctgggttacaagggggctgagggcccacttacccattcagcatacacaactacaaccagcatccaggaaagctacacagaggcccaagaaatagcctggaactgccaacacaggcrccagaatacactgtcccatggcacaagaacagacatgcttagcccaccactgctaccaatgaaacctgaaaagggatccatcaggcattccagtccccagtacaacttcacaatagctgccaccaataaccgccccataacaccaacaaacccacagctaccacaaaggctatttatagccaaagaaatcatgcagcgtttttatcactgcacatcctgaaacaaagccaaacagccctacctgcccaaacacatcatggtcacatagtcaagaaaaaaagtcccctcccaatgaaagta

SEQ ID NO: 206949 - DNA, 601 bp, Human
atggaaaagaggctgggcacaaatcctgttgtacccactgtagctggctctaacctgtaaacatcgcctactgacctagaggtcaacatgcaaagcccactgcaacaacttctaacacaagggcaaagtgcttggaaactagaagatcattgcacaaccactgctaccaccatgacccatgccaccctgggttacaagggggctgagggcccacttacccattcagcatacacaactacaaccagcatccaggaaagctacacagaggcccaagaaatagcctggaactgccaacacaggygccagaatacactgtcccatggcacaagaacagacatgcttagcccaccactgctaccaatgaaacctgaaaagggatccatcaggcattccagtccccagtacaacttcacaatagctgccaccaataaccgccccataacaccaacaaacccacagctaccacaaaggctatttatagccaaagaaatcatgcagcgtttttatcactgcacatcctgaaacaaagccaaacagccctacctgcccaaacacatcatggtcacatagtcaagaaaaaaagtcccctcccaatgaaagt

SEQ ID NO: 206950 - DNA, 601 bp, Human
cagcagtgccccattctactgttaccaatttactgtattagtctgttttcatgctgctgataaagacacacccaagactgggaagaaaaacaggtttaatggactcatggttgcatgtggctggggaggcctcacaatcatagtggaaggtgaaaggcacttcttacatggcagcagcaagagagaatgtgagcttgtgcagggaaaccccctttttaaaaccatcagatctcatgagatttactattatgaaaacagcaagggaaaggcctgcccccatgattcaattacctcccaccasacccctcccacaacatgtgggaattcaagatgagatatgggtggggacacagccacaccatatcaaatggcaaataatcacattagttatcagggaaatgcaaattaaatcttcccttcctagatatgcatccaacagaaatgttgatatgactgttcaagctgcattatttgcaatacccaaaagttgtaaacaactcaaaggtcttccaatgggtgaacagataaacaaattgtgatatatacatacaagagagtactattcaacaataaaaaatgaactattcatacatacatcatc

SEQ ID NO: 206951 - DNA, 601 bp, Human
ggcactattcacaatagcaaagacttggaaccaaccccaaatgtccagcaacgatagactggattaagaaaatgtggcacatatacaccatggaatactatgcagccataaaaatgatgagttcatgtcctttgtagggacatggatgaaactggaaaccatcattctcagcaaactattgcaaggacaaaaaaccaaacactgcatgttctcactcataggtgggaatcgaacaatgagaacacatggacacaggaatgggaacatcactcacctcggactgttgtggggtgggaggagsggggagggatagcattaggagatatacctaatgctaaatgatgagttaatgggtgcagcacaccaacatggcacgtgtatacatatgtaacaaacctgcacgttgtgcacatgtaccctaaaacttaaagtataataataataaaatttaaaaaaaaatcatctttgctccagttcgcaacaagttcctcatccccacctgagaccacctcagcctggactttattgtccatattgccatcagcattttgggcaaagccattcaacaagtctctaggaagttccaaactttaccatattt

SEQ ID NO: 206952 - DNA, 601 bp, Human
tcgcatccaggtcatggtgatgcaagaagtgggttcccatggtcttgggcagctccacccctgtggctttgcagggtacagcctccctcccagctgctttcacaggctggtattggttttccaggcacacagtgcaagctgtcagtggatctaccattttgaggtctggaagatggtggccctcttctcacagctccactaggcagtgccccagtagggactccgtgtgggggctctgaccccacattttcattccgtactgccctagcagaggttctccgtgagagccctgcctttgcarcaaacttctgcctgggaacccaggtgtttccatacatcttctgaaatctaggtggaggttcccaaacctcaattcttgacttccgtgcaccacacgctcaacaccacatagaagctgccaaagcttggggcttccaccctctgaagcaacagcccaagctgtaccctggccctttagtcacggctggagcagctgggacacagggcaccaagtccctagactgcatacagcagagggaccctgggtccagccccatgaaaccactttttcctcctaaacctcccagcctgtgatgggagg

SEQ ID NO: 206953 - DNA, 601 bp, Human
ctccatgtctcgcatccaggtcatggtgatgcaagaagtgggttcccatggtcttgggcagctccacccctgtggctttgcagggtacagcctccctcccagctgctttcacaggctggtattggttttccaggcacacagtgcaagctgtcagtggatctaccattttgaggtctggaagatggtggccctcttctcacagctccactaggcagtgccccagtagggactccgtgtgggggctctgaccccacattttcattccgtactgccctagcagaggttctccgtgagagccctrcctttgcagcaaacttctgcctgggaacccaggtgtttccatacatcttctgaaatctaggtggaggttcccaaacctcaattcttgacttccgtgcaccacacgctcaacaccacatagaagctgccaaagcttggggcttccaccctctgaagcaacagcccaagctgtaccctggccctttagtcacggctggagcagctgggacacagggcaccaagtccctagactgcatacagcagagggaccctgggtccagccccatgaaaccactttttcctcctaaacctcccagcctgt

SEQ ID NO: 206954 - DNA, 601 bp, Human
ttcgagagcagagaactggtctgaccacaaatttaccagggcggagtttttccccaccctagttaagcctgagggtactgcaggagaccacagcatatctcagtccttatctcaaccgcataagacagtcattcccagagcggccgtttatagacctccccccaggaatgcattcttttcccaaggtattaatatcaatattcctttctaggaaatgaatttagcgatatcttccctatttgcatgtccatttattgactctctgcaagaagaaaaacatggctctttctgcccgaccccrcaggcagtcagaccttatggttgtcttcccttgttccctaaaaatcactgttattctattctttttcaaggtgcactgatttcatattgttcaaacacacgttttacaatcaatttgtacagttaacacaattatcacagtggtcctgaggtgacatacatcgtctgcttatgaagacaacaggattgagagattaaagacaggcataaaaaattataaaagtattatttgggaactgacaaatgtccatattaaaatgagatcttcacaatttatgttcctctgcggcagctccagcca

SEQ ID NO: 206955 - DNA, 601 bp, Human
cctaaacaaaactacaaacaagagaaagtaaaagacatgtaaaagactcaatattgtaaagatgttaatcctttccaacatgttttatagattcaatacaatcccagtcaaaatcctagcagatgtggtggctcatgccagtaatcccagccctttgggaggctgaaacaagaaaatcacttgaagcaggagtttgagatcagcctgggcaacacagcaagagccaaagactacacgaaatttaaaaattagatggccatagtggtgaatgcctgtagtcctaacttcttaggaggcttargcaggaggatcacttgacatcacgaggttgtggccacaatgacttaaaatcataccactacactccagcctgggtgacagaacaagactttgtctccaaaacaaacaaacggtattagtctgttctcacactgctataaagaaatacttcagactgggtaatttataaagaaaagaggtttaattggctcatgattccatgggctgtagaggaagcatgatactggcatctgctcagtttctggggaggtctaaggaaactttcaatcatgggggaaagtgaaggggaaacaggcacatc

SEQ ID NO: 206956 - DNA, 601 bp, Human
tatgttttcaaatctcttcctctaaaccagatttttgaaataatattagctaagacagtgttgggaaaaaaaagtgacaaagagtatgaaataatgaaatctacagtcattttaaaacaggaataatttaaattggctcattgccaattgttttattcattcaaaaacaaagtcatcataaaacgaaagagaggctccacttctgaggtggaatgaaagatgatgctgttgaagcaaacgctttaccttttttttttgagatggagttttgcacttgtcgcccaggctggagtgcagcagygcgatctcagctcactgcaacccaagccctcctgggttcaagcgattttcctgcctcagcctcccaagtagttgggaatacaggcgcccaccaccacgcccggctaatttttgtatttttagtagagatggggtttcaccatgttggccaggctggtctcaaactcctgacctcagatgatccgccctcctggacctcccaaagtgctgggattacaggcgtgagccactgtgcccagctgactttaccttttcaccagtcttactgtgcaagtatattttcatgaaattatatcaattg

SEQ ID NO: 206957 - DNA, 601 bp, Human
tctcatttaagaaagggctggtttctctacctgcaatatgagtcaatagaatttatgttctttagcccacctgagtaaacttctacttttagcaagcttattcatcttcctaaagcagcaaaaagtagttaagagagagtttataaagcttgacacataaagggatcattaatatgactttatcaataaattatatatgttggcatttacacaaatggctgacataaatatccatggttttaatgtaagattaccagaaagaacacgtacatcttgttattttaaaaaaaaaacttatagrttaaatgttctttgctgaaatattaggattagcatacttttttccttctgaactcaaaggttagattattagactatgttttcaaatctcttcctctaaaccagatttttgaaataatattagctaagacagtgttgggaaaaaaaagtgacaaagagtatgaaataatgaaatctacagtcattttaaaacaggaataatttaaattggctcattgccaattgttttattcattcaaaaacaaagtcatcataaaacgaaagagaggctccacttctgaggtggaatgaaagatgatgc

SEQ ID NO: 206958 - DNA, 601 bp, Human
gaataaaatctcatttaagaaagggctggtttctctacctgcaatatgagtcaatagaatttatgttctttagcccacctgagtaaacttctacttttagcaagcttattcatcttcctaaagcagcaaaaagtagttaagagagagtttataaagcttgacacataaagggatcattaatatgactttatcaataaattatatatgttggcatttacacaaatggctgacataaatatccatggttttaatgtaagattaccagaaagaacacgtacatcttgttattttaaaaaaaaaacttatagattaaatgttctttgctgaaatattaggattagcatacttttttccttctgaactcaaaggttagattattagactatgttttcaaatctcttcctctaaaccagatttttgaaataatattagctaagacagtgttgggaaaaaaaagtgacaaagagtatgaaataatgaaatctacagtcattttaaaacaggaataatttaaattggctcattgccaattgttttattcattcaaaaacaaagtcatcataaaacgaaagagaggctccacttctgaggtggaatgaaa

SEQ ID NO: 206959 - DNA, 601 bp, Human
gtaagttaagcagtagttaagcataaggttcacattatctagattatctgtcaataaaaaaaattcttcatgacaaactgcacatcacctcccccaactagaattcaactgaaaatattttatgcataattccttgaataatgatctttttctattcatacctataaaagaattaacatacagaataaaatctcatttaagaaagggctggtttctctacctgcaatatgagtcaatagaatttatgttctttagcccacctgagtaaacttctacttttagcaagcttattcatcttccyaaagcagcaaaaagtagttaagagagagtttataaagcttgacacataaagggatcattaatatgactttatcaataaattatatatgttggcatttacacaaatggctgacataaatatccatggttttaatgtaagattaccagaaagaacacgtacatcttgttattttaaaaaaaaaacttatagattaaatgttctttgctgaaatattaggattagcatacttttttccttctgaactcaaaggttagattattagactatgttttcaaatctcttcctctaaaccagattttt

SEQ ID NO: 206960 - DNA, 601 bp, Human
atgtccatttggaagttcattttgttaaaagattaagtaaaatacacaccaggcaagaagcttagtaagttaagcagtagttaagcataaggttcacattatctagattatctgtcaataaaaaaaattcttcatgacaaactgcacatcacctcccccaactagaattcaactgaaaatattttatgcataattccttgaataatgatctttttctattcatacctataaaagaattaacatacagaataaaatctcatttaagaaagggctggtttctctacctgcaatatgagtcaayagaatttatgttctttagcccacctgagtaaacttctacttttagcaagcttattcatcttcctaaagcagcaaaaagtagttaagagagagtttataaagcttgacacataaagggatcattaatatgactttatcaataaattatatatgttggcatttacacaaatggctgacataaatatccatggttttaatgtaagattaccagaaagaacacgtacatcttgttattttaaaaaaaaaacttatagattaaatgttctttgctgaaatattaggattagcatacttttttcct

SEQ ID NO: 206961 - DNA, 601 bp, Human
gtaaaagcattttaaaaccaagcaaattttttaaaatactactattagaagtaatactactattaaaagcaagcaaatattttaaaatactactattagaaagatctaattatcaaatgttgttaactcccttagtcaagtatctaaatgcttatgtccatttggaagttcattttgttaaaagattaagtaaaatacacaccaggcaagaagcttagtaagttaagcagtagttaagcataaggttcacattatctagattatctgtcaataaaaaaaattcttcatgacaaactgcacrtcacctcccccaactagaattcaactgaaaatattttatgcataattccttgaataatgatctttttctattcatacctataaaagaattaacatacagaataaaatctcatttaagaaagggctggtttctctacctgcaatatgagtcaatagaatttatgttctttagcccacctgagtaaacttctacttttagcaagcttattcatcttcctaaagcagcaaaaagtagttaagagagagtttataaagcttgacacataaagggatcattaatatgactttatcaataaattat

SEQ ID NO: 206962 - DNA, 601 bp, Human
gcatcatcacggtaagaatggaaggtatgttttgcaaaacgggaaagtgctttcactagaacttcttagtggactcaacttggtatcttgagactcagggtcaagacttagacatatctaggcaaagaacagtctctatcatcagatgttttggttttcaggctatttcaggttgacttcatcaacagaaacccaggagcctgttgctatagtgcaccgaagaaatagacaaatattacctcataaaaactagttccaagacatcattgtgttgaatttaatatttttaaaaatctgataagattgactaacagatcactctgaccaacacacagttcttcaattctgaaaattttctataaagactggaccacaagaaaccttaaaaatgaacttctctaaaattctgcctgagaggtttctggcatggcaataattagattataaaatgtacttttaaaattaaaagcaccaacaattaagaaaaaatggcaatactcagacaaagctttaatagcaatcatttgacaaatgtaaaagagttttaaacctctatttccgtaaaaaggtaaaagcattttaaaaccaagcaaatttttta

SEQ ID NO: 206963 - DNA, 601 bp, Human
caaatacagtaccatttcatttagcctaggaagtgatctttaaacaagatatagtcctaccaaaacaagcttcagtggcttcaacccagagatctcagataagtaattttatcattagggccaaagactcctttgagaatctgctgagagctatgaatcttctcacaagaaaaacccagacacagacacccaaattttacacagcacgaagttcactgacggaggacacgggagatcccagaatcaaacccttgcccagatgctctataccagtcttacctgctcttgaaattttttttawcatatactaccatcagtaaaaacaaaatttgagcatctataccccatatatgtgtatttaattatttataagctacatatatactattcaatgacatatacagacaaaacaaagactttaaaaatcataacaataaatataaatgcaagttctaatagtttcttcacacagtccaacgacttactttatgaatgcaaggaaatgcacaaactccactttggaaaccactggtatatgctctgtggtgggtaatcctaccagccctgtacatggcctgtgtcctacgttgtgacagcaata

SEQ ID NO: 206964 - DNA, 601 bp, Human
ttcaaatacagtaccatttcatttagcctaggaagtgatctttaaacaagatatagtcctaccaaaacaagcttcagtggcttcaacccagagatctcagataagtaattttatcattagggccaaagactcctttgagaatctgctgagagctatgaatcttctcacaagaaaaacccagacacagacacccaaattttacacagcacgaagttcactgacggaggacacgggagatcccagaatcaaacccttgcccagatgctctataccagtcttacctgctcttgaaatttttttkaacatatactaccatcagtaaaaacaaaatttgagcatctataccccatatatgtgtatttaattatttataagctacatatatactattcaatgacatatacagacaaaacaaagactttaaaaatcataacaataaatataaatgcaagttctaatagtttcttcacacagtccaacgacttactttatgaatgcaaggaaatgcacaaactccactttggaaaccactggtatatgctctgtggtgggtaatcctaccagccctgtacatggcctgtgtcctacgttgtgacagcaa

SEQ ID NO: 206965 - DNA, 601 bp, Human
aaaggtataagttatctggtgtgtcagctgaaatgagctgtgactttttcctgtcaggcattgcaatatttgatgagccatcccctcccagggcatattcaaagtaaaatacatatggacagctcatctgaaatcttttgtgcctcccaaaggtcaccctctcaaacatcaaggttggaaaggcctggtgatctgagaagctttattgctgctcatatcgtttaagttatctgaaaactggaccttaatgaatccatcagtatgtggccttttacaatagctaaaagccccagtatggagkcatatgcattcaaatcatgtcaactcaggtaaatgagctaatgtcaggatttttaaaaattttctacaagaagtcactgcctttcccttcttctgtcataaaattacaaccccctcccaccccaaaccaagataatttactttgtcctggtatttttaaagtataaaacttgaaatatgtttagcactaatgtggaaataagcataaaaatacattcataggttacgtttgtaccctttagctaaacctacccgtttttaacaccattacaatacatgtgactcttggaacacataacag

SEQ ID NO: 206966 - DNA, 601 bp, Human
tcaagcttgttagaaaagggactgagtgaagacagaggatcactgcggtacccactgactgagctgaaatgaaggcacccttttaggatcgattatctgagttcacgcctaaaacttggctgtcatgtaggttatgcattctgaaacgttctgatgtgtctcttctgcagacaactccagaaacaatcccgtccattaccaccatcaccacagctaaatttctagtgtttactatgtgctagatattctctgagatggatactattattatcaatgggcagagtagcagaggggaaaaaaatctctacaaaaaaaaagaaagaaaggggatagctactttacaatcaaattacaagtctcagctaaatccctgttaagatctcagatcattcaaacattacatatacttaataagactctttttctatgtataaattgccccgtagcacaccccaaagaatactgaaaaacactggggaagaaaagtaaatgtatctattaggtagttttatacaactcttgctaattctactctctcttatggtcaaggaactgacatgcatataaggccttttatatcaggttatgttttattacttta

SEQ ID NO: 206967 - DNA, 601 bp, Human
tgctgcaaggcggaagtcctgccccttccaggacagcacgtgagggtcctaagagcctgtcccttcttctcagttcagtggagctctgaagggccatcgaagtcacaacatccccgagggccagcggaggcttccagtgtgactgcatcacggcacagttcctccctctgcacagccccttcctcttccgttgtcccaacccggctaataaacctcttcctggcaagcagattcccatctgaagtgtgcttctcagggaacctaacccgagacagatacgttcccacttgcattttaaaakgcacacacacaggctgggcgtggtggctcacgcctgtcatcccagcacttcaggaggccgaggtggaaggatcgtttgagctgaggggtttgagacaggcctgggcaacattgtgaaaccccatgttcatgaaaaacacaaaaattagctggctgcagtggctcatgcctataatcccagcactctgggaggctgaggtgggagaattccttgagctcagcaggttgtgactgcagtgagatgtgatcacaccactgcactccagcctgggtgacagaggagaccctgtctcaaaaaaat

SEQ ID NO: 206968 - DNA, 601 bp, Human
tgtgcgtctcacagtgctttctgatgcccatttacagaaggcttggctgtttctgaatcccttgaagtatttggtaagtgaagtttatgaagccctgcaaaaaaattaagaaaatggtgagaaatgatatattgctgagtggctgggaaagggttagggtagggagaagaggagatttacaaagctaagtgttatttggaaagctgtgaggtgctggccagatccccttgaggaatgaatgatttcttctccctactggcaacctccctttggggatggcctaagctgaagactgctgcarggcggaagtcctgccccttccaggacagcacgtgagggtcctaagagcctgtcccttcttctcagttcagtggagctctgaagggccatcgaagtcacaacatccccgagggccagcggaggcttccagtgtgactgcatcacggcacagttcctccctctgcacagccccttcctcttccgttgtcccaacccggctaataaacctcttcctggcaagcagattcccatctgaagtgtgcttctcagggaacctaacccgagacagatacgttcccacttgcattttaaaatgcacaca

SEQ ID NO: 206969 - DNA, 601 bp, Human
gcttattagactgtacaacagaagatattcctgtggctctctaaggctccaggtttaaaagaatttagtattttccccttggctcaaagtctaatcagtatcattctataacataaatcagaaactacgctttttgcttttaaggaaataagaaacataattgcaaccattacagctccaacatacactgcaaaaatgatatctacaagcagttgccattgcatttgaaaaatgcattttctgaataagcttcacttagtaccaaggatgcctttcaagtcagcttctacattctgaataragtacataatgggatttaagtaaatctttagaagtcccggagtttgccttttctaacattttcatatcaggtgaaaacaattttttcatatgggtgattgtatttaccaacatgagcaaatgtctacagaagaatgcgctgttctatatgtctgtaaggaatctgcacttaactggaaactacagggtccatcagaaagttaaatttaaaaaagatcagccatagccaagttcttcgtagattatgaaaaaaaaatggcactgataggtctaggttctgaagaggggccacggttgaatg

SEQ ID NO: 206970 - DNA, 601 bp, Human
accatgaatgctgatgctgtgaactttggatgttaaactggtaaaagctggaggcttcaaatggcatatgcaaatgtaaccaaagcctgaggactatgaagaaagaggagtttctaccactcggcatttatagtttttatatgcattgcagaagcatggggaattaagtgatctctgaaaaaaatgctttaaaaaactgagtatacatatagcctataaggtaaaaatccaagttacaagtgtattaaacactggcaactatgttatcagagggaatactgaattatatatatacataaastgtcattaaactgtgattacatgatacttcctaccacagcttattagactgtacaacagaagatattcctgtggctctctaaggctccaggtttaaaagaatttagtattttccccttggctcaaagtctaatcagtatcattctataacataaatcagaaactacgctttttgcttttaaggaaataagaaacataattgcaaccattacagctccaacatacactgcaaaaatgatatctacaagcagttgccattgcatttgaaaaatgcattttctgaataagcttcacttagtac

SEQ ID NO: 206971 - DNA, 601 bp, Human
aactttttaggtatgtcgattttatgctgagaaattcaccagtactatactggtggtatttactgaagcttgtttagaatcacaaaatgaatgttcttttattttaaaaccaagctgcattttagaaagatgtgaagctcggaaggaaatgcagacgtataaataagggggaagtgtactcaacaaaggttgtaaatatacagattaaagtttcttattattttggtttaaagtggaaatttctgatgtcaaatagacacagcctgcgtttcataaatttctcccagaaaacctttaaatrtaacaatttgaaaaaaatgttttacttttgtctgaacacagaccatctattttcatacacacagtgcatgtgaacatatttatatagcagactgcataactacgaattgtgtgcaaatgggcccatctcctatttttgcatgcacagatttcggtattctatcctagtggatggttgacacagagtgcaatttcatagtttttattcagtggacttaaagccaagaaaccatcccaataattatttacaatttaataactgaatgattatcagatcgtgttatactgcaaaactgttctt

SEQ ID NO: 206972 - DNA, 601 bp, Human
gacagttgggagggaccttgagggctttataaggcaggcctggagcatcaagcagagcagagacctgagaggcaccaggcccagccgtggcaccacacacctcccagctctgcaggtgagaaaacccaggaggagaggggagaggctaggaagtgggttgacaggtcctctcccccatcaaggtaccaggccactggccagagtctggggctcaccccttggggtctccagagctgggaccctttctttatcccaggatggaactaggtcttggctccagtacctaccctggtattcccarccttgccttccacctgcccttctgccgcagccggggccctgcccttagcctatcccttcacactcttcccagccctgggaggtgaggaggactggggttcttctcctttctctcagacaagaaaactgaggcccagaggcaagatgtgacttgcccaaagtcacagggattattaggcaaggctgggataggaatccacagctcctggatcccacttcaagccctttcctagaccagtgccatccaaaagaacgtcctatgatgcaggaaatggtcttcatctgcactgttcaatatggt

SEQ ID NO: 206973 - DNA, 601 bp, Human
caaccccctcagcctcccaaagtgctgggattacaggcgtgagccactgcacctgaccataattttttaatttaattaatttaaatgtaaagagccacatgtggctggtggctatagcactgaacaacacatgtggttagcatctgacaatacagctccagatcactgatttttcaaacatttcttcagcagcagaattcttttcttccaaagaaaacctaacagaaaacctgattatgaaaaacttaatggccaggcaccgtggctcatgcctgtgatcacaacactttgggaggctgargcaagcagattgcttgagctcaggagttccagaccagcctgggcaacatagtgagacctcatctctactaaaaataaaaacaaaaaaattagctgggcatagtagtgcacacttgtagtcccaactactcaggaggctgaggtgggaggatctcttgagcccaagaggtcgaggctgcagcgagtcaggatcacgccagccactgcattccagcctgggagacagagcaagattctgtctcacaaaaagaaaagaaaaaaagaaaaacttaaaagcagtacagtattttattaatacaaa

SEQ ID NO: 206974 - DNA, 601 bp, Human
gcatgccaccatgcctggctaatttttgtattttttgtagagatggggtttcagtatgttgcccaggttggtctcaaacttgtgggctcaagggatccatcctcctcagcctcccaaagtgctgggattaccatgcctggcctaaaaagttcactttaaataacaagtcttgggctgagcacagtggctcacatctgtaatcgcagcactttgggaggctgaggcgggaggattgcttgagcccaagagttcaagactagcttgggcaacatggtgaaaccctgtttctacaaaaaatacaaaaaaaattagctggacgtggtggtgcaagcctgtagtcccagctcttctggaggctgaggtgggaggatcacctgagcccaggaggtagaggctgcagtgagcagtgattgcactactgcactgcagcctgggcgacagagtgagaccctgtctcaataaataaataaattacattatttaaacagctacagaaccactaacatggcctcaaattctgcagaacagaaactagggaaaccattgccctaggatttgactttctccaatagaagcagtggctgtaatcggggtaggtaaa

SEQ ID NO: 206975 - DNA, 601 bp, Human
cacagtggctcacatctgtaatcgcagcactttgggaggctgaggcgggaggattgcttgagcccaagagttcaagactagcttgggcaacatggtgaaaccctgtttctacaaaaaatacaaaaaaaattagctggacgtggtggtgcaagcctgtagtcccagctcttctggaggctgaggtgggaggatcacctgagcccaggaggtagaggctgcagtgagcagtgattgcactactgcactgcagcctgggcgacagagtgagaccctgtctcaataaataaataaattacattayttaaacagctacagaaccactaacatggcctcaaattctgcagaacagaaactagggaaaccattgccctaggatttgactttctccaatagaagcagtggctgtaatcggggtaggtaaagagaaaaaacacaagacttcggggctggtgtggaactggcagaaactggagaactgatctgaagaaatagtccacaactccacacagaattgcagactcacccgggtgcggtggctcatgcctgtaatcccagcatttgggaggccgaggcggctggatcacctgaggtcaggagttcg

SEQ ID NO: 206976 - DNA, 601 bp, Human
aattaccgacagcgatggtggcacgtgcctatagtcccagatattctggaggctgaggcaggagaatcacttgaacccgggaggcggaggttatagtgagccgagatcccaccactgcactccagcctaggcaacaagagtgaaactctgtctaaaaaaaaaaaaagaaagaattgcacactcatcagcaggtagaggcctggagccacatggttcagtcccctgcctctgggcctctgtggggacagcctcacccttaagctagtcccttctcccctttgcagacgagatgcagcgactrtgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcaggtaggagctgctgactgccctgcttgcctcacttggccaggtttggccaaggtctccccagactggctctgacttcagttcctggaaggtaggcatccttc

SEQ ID NO: 206977 - DNA, 601 bp, Human; identical to SEQ ID NO: 27851

SEQ ID NO: 206978 - DNA, 601 bp, Human; identical to SEQ ID NO: 27852

SEQ ID NO: 206979 - DNA, 601 bp, Human; identical to SEQ ID NO: 27853

SEQ ID NO: 206980 - DNA, 601 bp, Human; identical to SEQ ID NO: 27854

SEQ ID NO: 206981 - DNA, 601 bp, Human; identical to SEQ ID NO: 27855

SEQ ID NO: 206982 - DNA, 601 bp, Human; identical to SEQ ID NO: 27856

SEQ ID NO: 206983 - DNA, 601 bp, Human; identical to SEQ ID NO: 27857

SEQ ID NO: 206984 - DNA, 601 bp, Human; identical to SEQ ID NO: 27858

SEQ ID NO: 206985 - DNA, 601 bp, Human; identical to SEQ ID NO: 27859

SEQ ID NO: 206986 - DNA, 601 bp, Human; identical to SEQ ID NO: 27860

SEQ ID NO: 206987 - DNA, 601 bp, Human; identical to SEQ ID NO: 27861

SEQ ID NO: 206988 - DNA, 601 bp, Human
aggcaggcaaaatacatgaattctaaggcctttccattctaacattccatgcttttatcagtgaaatgaaacagggaggacagaaagaacagcgtaaccctgtgtgtatataggaggcatcctgtctccatgcagccctctaccaccttttgtctctggccctccccagaattttacctcatcctcattctccactttagggttgctggctgttcgtttcaggttgctgctgagacttatgctggcagtggcatctgacttagagcgctggtgagtccttttggagggagacagccctgtrtcaggggccgggctcaaggagggcagctccctcttcctgtgagctggctttagctcatctgagaggatcagcttccgtagcttggtcccacgggagtgtcgttgagtggaaatgtgcatgtctgaagaataggccccaagcaacagggcacactggagggaaaagttaatgctctggcggcaacggtggactatgtagggcttaatggcatcacccacgtcctcatccatgtggatgtacatgttaagcaactggggcagatagaagtccacgtcctcgttgcgaaagcagaagagccgg

SEQ ID NO: 206989 - DNA, 601 bp, Human
tttagtaagctgtatacttcctgcttatggcagaaaacaactttttcaagagagtcacaaactaaacagttccatagatactggggttttcattattacttcacatgttcctagagggaaggataacattttatcccccgtcctccacagcacagctcacggctttggacattgtacaaagtcaataactacatgttgagtgaatgaatgttacatgaaagggaagaaggatgagtaaaaggaaaaccaattcctttggtatttaggggacaaaagccttgacagacgcatcctcaaaatgccaaaggggctgggtctagtcactcatgcctgtaatcccagtgacttgggaggctgaggcgagaggatgacttgaagccaggagtttgagactagcttgggcaatagagcacgacctcatctttacaaaaaaattttttaaaaattagccaggtgtggtggtacatagctgtagccccaggtacttgggaggctaagatgggaggattgcttgagcccaggagttaaaggctacagtgagctatgactgtgccactgcacgccagcctgggcaacagagcaagaccctgttgcaagaaaa

SEQ ID NO: 206990 - DNA, 601 bp, Human
cgtggtggtcaaagccagcagtgggcagccagactcgggcagggagcttatggttgagcagggagagctctgagatcagcctctgtgttttctgctctttggtggggagcgtggccagccgcttgccgatcgccatcagggacttgatgaattctctctcaggagccagtcgaacaggctacaggggtttggggtaagacaaaagatggtgaagaaaccatagaatacaatggcacacccactcagtcactcctggccatgcaggccggggaccccactatctggagaactccaggaaagsagctgctttttagtcttagtaggagcttccacccacccttcacaacttgaattgagaatagccagcacattccttccctataggctatcccttgagggtaagggaggccatgagtccaggtaactgggatgcactcctcttctcctggacttgggttccttaaggactgtaccaaggcttcagagtgagcagggggacatctggataggttagccagggccacagagagaagagctgcttacacctgaattgtttcacccttttcaagaacagggttgtccttctccccatctggatcct

SEQ ID NO: 206991 - DNA, 601 bp, Human
aaaaaagaagaatctgaaccatgaatactcattccagtcagcacacaaattcagctaattctctccagtgtgaattgggcatccttctctccttttgtcggctcattctgatcagaaaaggtcttagaaacaaaatatttctctatccttatggttgctgtatctggaaagcccaagagttatagaaaggctggagaaaagctaccaaaatgaccataaggtggggtgaagagcaattctcctaagatacagcaagaaggaagctaaaaagattaggtttctttggtccagaaaaacaaarcccaaaaagggatacaggggggctctcaaaatcacaatcgcactgagacagagtcatggttgacatatgcatcatgaactatgaagggagtctaggatgttggtgagggcctcactggtcatacacgcaaactctgaacaaccatgggtgaagagtcacgtccagggtaggggtttgggccagaacccatctaccttgtccttggagttgaggacaacagcctgtgtgtggggtacacggaccacgtggtggtcaaagccagcagtgggcagccagactcgggcagggagcttatggttg

SEQ ID NO: 206992 - DNA, 601 bp, Human
ccaagtcttgttcactagcatacagcactcaggtctggcacatagaaggccctcaataaaaatttcttgaatgaattaatgtatgacttctcatcctctgctattctatgacaactttatgtaggtgttcaataaatattttcattaaatttccctcactccccttggcctagaagctcctctttacatttaaatctgaatccttcacctggaaaatgaactccacctgaatctattccaggctagagttgttcagagctttccccatattacccctcactacctacaccactcattaggrtacttgccttaccctgccttgggatatgctgtcttgtttccaatatagtgaaagctcctggagaaagctcctgtgacccagcattacctccctgaagccctctcacctccacttgcagctcgcctatgtcatccaccgaccaggcctcatcatcgttgtcatagttgggcacagtgctgaagctgccagctcgctgctcatgggtaataccacattcgggcaagttttctacggacctcgtactccgaattcggttctcggggatccgggcagggacactggtggtgtcaaagttttcac

SEQ ID NO: 206993 - DNA, 601 bp, Human
gcgagactctctccgacgaaaaaaaagaaaaaaggaaaggatttaggtccagagaagacttctctggaaaatgaaaatatttatatggtataaagaacagtattaaacaattaagtggcttgcaggtgaccaacccaggggtatcagaagatcaatatttcagcacactataacctacctgctacagaccaatttgggaagtttttatgttgttttttaaaggggggaggaccaaattattattatttaaaaatttgattacaaccaattgtgttggcattaaaattagaggcattaagtytgaataatggatatatgccaaaaaccaaaaattgagtttggcaaaaacgggcaaggaagttttccagtaatttcagattagaaatcaatttagagaaatgaaccccatgtttacaatgattgtgccacagatttaaacttcagtagtgcattagtaaactgttcacatttagatcttcaccttgagatttgacagctatttcttgaaaaaatctcagtgccttgtataaataaattggtcttccatgtgccttagcacacacttaacactaggaaaaggtgggtcactaaactttgcctc

SEQ ID NO: 206994 - DNA, 601 bp, Human
tcagccgaaatcacaagaatcttgtatggcttgatccaaaggggcactcgctcctgttcccaaatggactgtgaggagacatggaggatacaggactcttatctttctccaaactagagaagaaggctaaaactcttccctttctccagcctctctccttggtagcattgaattctaagccatcaaatgagtaagactcacttaacccagtgaggaccagggagtttggaaaggaagtctagggcctgacaaagtcagaaactacactcaggtatgtgggaaaaggtatcacctaagtagmaagcccaagacaggcagggagaacaggaaacttcactatcccctctcaagcagggagaatgggagctgtaagttcaaataataagaaaaaagaggccaggtgcggtggcttatgcttgtaatcccagcactctgggagaccaaggagggcggatcacctgaggtcaggagttcaagaccagcctggccaacctcagtagagagtgaaacctcgtctttactaaaaatacagaaattagccaggcgtggtggtgtatgcctgtaatcccagttactcaggaggctaaggcaggagaatcgc

SEQ ID NO: 206995 - DNA, 601 bp, Human
gtgcactgaggaatgcctcagtggtgtaactgccgtgctcctgtaggaagtaatcgagcaaggagagctgtgactgtttcttcacctgatggatggacacagcattgaccactggttcaatcatgccactatcagccgaaatcacaagaatcttgtatggcttgatccaaaggggcactcgctcctgttcccaaatggactgtgaggagacatggaggatacaggactcttatctttctccaaactagagaagaaggctaaaactcttccctttctccagcctctctccttggtagcattkaattctaagccatcaaatgagtaagactcacttaacccagtgaggaccagggagtttggaaaggaagtctagggcctgacaaagtcagaaactacactcaggtatgtgggaaaaggtatcacctaagtagaaagcccaagacaggcagggagaacaggaaacttcactatcccctctcaagcagggagaatgggagctgtaagttcaaataataagaaaaaagaggccaggtgcggtggcttatgcttgtaatcccagcactctgggagaccaaggagggcggatcacctgaggtcagga

SEQ ID NO: 206996 - DNA, 601 bp, Human
taataagctgctctgttagctagctagctagctagttgttttgttttgtttagacagggtctcactctgttgcccttaacctcctgctcaagtgatcctcccacctcagcctccaaagtagctgggaccacagctgtataccaccatgcttggctaatttttattttttgtagagacgggatctaactatgttgcctaggctagtctcgaactcctgggctcaagcgatcctcctgcctcggccttgttggctagattttttttttttttttttgagactcgctttgttgcccagactaawgtactgtggcatgatcttggctcactgcaatctccacctcctgggttcaagcaattctcctgccttacctcccgagtagctgggattacaggtgtgcatcaccaagcccagctaatgtatgtatgtatgtgtatgtatatatataaatttttttttttttttgagttggaatttcacccttgtcgtccagtctggagtgcaatggtgccatcttggcccactgcaacctctgcctcccgggttcaagtgattctcctgctcagcctcccaaatagctgggattaggcgcctgccaccagg

SEQ ID NO: 206997 - DNA, 601 bp, Human
ctaataagctgctctgttagctagctagctagctagttgttttgttttgtttagacagggtctcactctgttgcccttaacctcctgctcaagtgatcctcccacctcagcctccaaagtagctgggaccacagctgtataccaccatgcttggctaatttttattttttgtagagacgggatctaactatgttgcctaggctagtctcgaactcctgggctcaagcgatcctcctgcctcggccttgttggctagattttttttttttttttttgagactcgctttgttgcccagactawagtactgtggcatgatcttggctcactgcaatctccacctcctgggttcaagcaattctcctgccttacctcccgagtagctgggattacaggtgtgcatcaccaagcccagctaatgtatgtatgtatgtgtatgtatatatataaatttttttttttttttgagttggaatttcacccttgtcgtccagtctggagtgcaatggtgccatcttggcccactgcaacctctgcctcccgggttcaagtgattctcctgctcagcctcccaaatagctgggattaggcgcctgccaccag

SEQ ID NO: 206998 - DNA, 601 bp, Human
tcaaaatcctgacactttgagatagtctgaagcttgcaatcaaattccttataaataattgcattctcggccggatgcagtggctcacgcctgtaatcccagcactttgggaggctgaggcaggaggatcacctgaggtcaggagtttgagaccagcctggccaagatggtgaaaccccgtctctactaaaaatacaaaaattagctgggcgtggtggcgcatgcctgtaatcccagctaatcaggaggctgaggtgggagaatcacttgaactctgggaggcagaggttacagtgagccragatcacgccactgcactccagcctggacaacagagcaagactctgtctcacacacacacacaaaaatattacattctcctacagctctcaaatgcagagcctgggtccatttgtagggctggcagggtggaatgagcgcagggtggaatgagcacagggtctaaaagctacctgactgttatttccctcatgaggaaacacgtgtctgacagggttttcatctggtttaaatataagaatgtcaggccatggcagaacttaatagatgctagatttcttttttttttttttgagatgaa

SEQ ID NO: 206999 - DNA, 601 bp, Human
cattatctcttcaaatatttcttctgcctcactcctacttttaggactccaagtaaaaatatattagaccatttgctatttgtcttacctcttgattgctttgcctttcctccactctttctctcttagtttggataatttttattgatttttctataggttcaccgtttttctttgttgtgttcattctgctgataagccccaatgaaggacttcttcatgtttttaatttctaatgttttcattttccttttaaaaaagtttctgtctctgctaaaattccccactagatccataaacrtattaattatagttattatataatgtctgtcagtttcaatatctggtccatctctggatctggttttgctgactgttttaatctcttgtttttgtatgtattttataattttggattgaatatcagacattgcaaaagaatggcagggacggaagtatgtaatatttctacccagaaataggcatgcctctactctgttaggctgttagtgtgaacaggtattggtcagtctagttagtaattgagaagagttttgagtgtttgtggttgcagtaattaccatcagtacaccacactctt

SEQ ID NO: 207000 - DNA, 601 bp, Human
tagaaatataggcaggaatagaggtgatgtggtgagattacagctcttaagtttggaatttatcagcattgcttctgagtggaataatctaggaaaagtatggtgtaatgaagccaaggaagctaagctgaagtgtgaatggccaacagtgtcaaatgttgcagaacacttgaaaatgattggctaagaagaagttgttgagaaagtagcagccaaaagattaggattcaaaatatataataagtgctgtgctggctgggcgcggtggctcacacctgtaatcccagcacttttggaggcygaggtgggcggatcacgaggtcaagaggtcaagtccagcctggccaacagagtgaaaccccatctctactaaaaatacaaaaattagctgggtgtggtggcgtgtgcctgtaatcccagctacttgggaggctgaggcaggagaatcacttgaacccaggaggcagaggttgcagtgagccgagactgtgccactgcactccagcctggcaacagagcgagacttcgtctcaaaaacaaaaaaaagtgctgtgctgataaatgtttaacaactggctagggacaggctgtttagcttttg

SEQ ID NO: 207001 - DNA, 601 bp, Human
aaattagttacaaataagtttctttttgctgtagactttaaaatgtagattagcaaatacagagttttatctcttgttcatgatagttcatgaacagacccagtgaaaggaagtgctgccatggtaacgtaaaccagactgttacttgagaccatactcaagatacttaactgccctgaaactgcacgttttcaataccagtttttccaatttgctatttcaaggaaatagcaactctactgtgatcaaaacaatttgcagtcccctcacaatagaatttgaaaagtagacttgaactaarcaatttctaggagcgtaatctcaggaattccaaggtagagcatggctagcattattaaaataattgtcttggtctgtgtatgaaaagtaatgctgcgtatcttttctatatgaaactgaattggctttggggcaaaagatgttgtaggtgctaacattttaattcttcctttttttttttttgagacagcgtttcactctgtcacccaggctggcctcagcctcctgaatagctgagactataggcgcgcaccaccacaccaggctaattttttctatttttgtagagacagagttttgc

SEQ ID NO: 207002 - DNA, 601 bp, Human
agtgaaaggaagtgctgccatggtaacgtaaaccagactgttacttgagaccatactcaagatacttaactgccctgaaactgcacgttttcaataccagtttttccaatttgctatttcaaggaaatagcaactctactgtgatcaaaacaatttgcagtcccctcacaatagaatttgaaaagtagacttgaactaaacaatttctaggagcgtaatctcaggaattccaaggtagagcatggctagcattattaaaataattgtcttggtctgtgtatgaaaagtaatgctgcgtatsttttctatatgaaactgaattggctttggggcaaaagatgttgtaggtgctaacattttaattcttcctttttttttttttgagacagcgtttcactctgtcacccaggctggcctcagcctcctgaatagctgagactataggcgcgcaccaccacaccaggctaattttttctatttttgtagagacagagttttgctatgttgcttaagctgctcttgaactcctgagcacaagcaatcaccttcgccggcttcccaaagtgctaggattacagacgtgagccaccgcacctggcct

SEQ ID NO: 207003 - DNA, 601 bp, Human
ttattaaaataattgtcttggtctgtgtatgaaaagtaatgctgcgtatcttttctatatgaaactgaattggctttggggcaaaagatgttgtaggtgctaacattttaattcttcctttttttttttttgagacagcgtttcactctgtcacccaggctggcctcagcctcctgaatagctgagactataggcgcgcaccaccacaccaggctaattttttctatttttgtagagacagagttttgctatgttgcttaagctgctcttgaactcctgagcacaagcaatcaccttcgcyggcttcccaaagtgctaggattacagacgtgagccaccgcacctggcctggtgctaacatttttttccttgtcatcaaaacacatttatcatttggtccaggtgactgaacatatagctaagttaagaagtttcatttaatccaaaaatacatttgtaaaacttgtcttttattgaaaaaaaaaaaaaaaaaaagaaaatgtcaaatacttttttagtatagttaatgtgatatcttgctgctaaacaccaggaaaatgtttctcctgataatccagtgcatttctttctttatgatagt

SEQ ID NO: 207004 - DNA, 601 bp, Human
agccaccgcacctggcctggtgctaacatttttttccttgtcatcaaaacacatttatcatttggtccaggtgactgaacatatagctaagttaagaagtttcatttaatccaaaaatacatttgtaaaacttgtcttttattgaaaaaaaaaaaaaaaaaaagaaaatgtcaaatacttttttagtatagttaatgtgatatcttgctgctaaacaccaggaaaatgtttctcctgataatccagtgcatttctttctttatgatagtgtgatatgacaaccatggtttttctatttatrtaaattgccagcatagtaaaaaactgccttacactcaattgctacaccttttcacaggcaaaaggttttattctctcctaaattaattttatcccgtttttttttaccacctaacttttgccttttattcagaactaatgtatttttttcttattgtcgtttttttttcaaaattccctcctcggtggaaagtaaaggagtaggaacatactattattcaaccaacatgcagcaacccttacgtacgtcagtttcagaatggccccttaatattcacctattttgcagctatgtctcttg

SEQ ID NO: 207005 - DNA, 601 bp, Human
ttagctgtatttgtgactaagttctataaaaagtgaaatagttgggtgcaagtggctcacgcctgtaattccagcactgtaggaggccaaggcaggtagactgcttgagcccaggagtttgagactagcttgtacaacatggtaaaaccctttctctaccaaaaaaaattaaaaaattagccacacatggtagtgcatgcttgtggtcccagccactcaggcagctaaggtgggaggatcacctgagctcagaaagtcaaggctgcagtaggctgaaatcatgccactgcactccagcctrggcggccagcagagtgagagagaacctgtcaaaaattagggggaaaaagtgaagtaaacatttttataagcatatttgcttttctgtttgtttttcagtggttctttatcacctcactatttaagctctgtaatcaagcagaaccaggtgcgaaacctcaaaggtatgtgtgaatatcagtacagtcatgcaccacacaacaatcttttggtcaacaacaggcagtgcataacaatggtggtcccctaagattataatggagctgaaaaatttctattgcctggtgccctggtagcttgt

SEQ ID NO: 207006 - DNA, 601 bp, Human
aaaacatttattaaagagaaagtaaagtcatttatcccattgttaatattttatttttatttatttatttatttatttgagacaggttctcactctgtcacccaggccagagggcaatggcacagtcatgactcaccatagcctcacaatcctgggcttaagccatcttcccaccttagcctcccaagtagctaggactacaggtgccattacacctggctaattttgttgttaacattttgatataattcctttggggtttttttaatgccacatatgtgaatagatacacttgcatgcrtgtatgtacagggacacatacataaacacacacatactttttctccagatactagattcacactgtgtatacagttttatatcccttttccatttatttttatgggtatttttcattgaaaataggattgaattttttagtaatatcagtagagttattaccttttcaggtctatcttagactagaaaaggggttggcaaactatggcccatggccatttctggcctgacatctgtttttgggtgtcccatgagctaaggatggttttacatttgtaaaatggttggagaaaacaaaatc

SEQ ID NO: 207007 - DNA, 601 bp, Human
tcaagactgtgaaaattcattgcaacagagacctacatattatatcctgggttttgcctcttagcatgcaaagcctaaaatatttaccttctgaccctttactgaagaagtttgtcatccctcaaattagaatatgcttgaagatatttctcctgtaggttatttaatctgaagaactttaattttaaaagataataagttgactttttaaaagtatatcaaaattctgaattagtgggtttttttcttgtagattagtagtatattaaaatcagttttcctagcgttgctttggagcctrgagacattttcataacctttaaaaatagaaaatttcagatgaaaacctttctgtgtatcagaaatattttggctctttggaactatactaaactgagcctcagaagcagtgtgctgatatctttaaaaataaaggaggaaaagaatatgaaaaagttctagagaaccctgcaaagaagttaaatggataggggatctgtttcaaataatgttctgccttaacataagacaaatatccgtgttcctgttacctacatcagtcaaatgtggtttctctttacatttaggtattgccaaaatg

SEQ ID NO: 207008 - DNA, 601 bp, Human
atagtgaagtgacatcgtcagttttatgttttataaagatcacttaggtattatcattggcctccaatattaaaacttacatattcatctaacacttcatagaatcatctttactgatcattatattagagctacctttagacacggaaaactaaagggagagattaggcttagaactccagaaactgttatcagcctaaacaggtgcagcagtgtgtttgttgtctcttgatcaacttacaatgacttttatgtgacagtatcaatgttatggcattgtataatagatagcaggagacasaggattcttacactgagatagcagaacgaaattttttttggtcaatagtttggtttggtgtgtatttagagtaaattcacctgtttaaaaatattactgagctgttctagacaccaaggtacatcagtgaaaaaagcagacaaaaatggaactcacattccagttagtaaattttagtagttatactaactgctaaaagcacctggtatactacaaacagatataaaattaaggtagttgatggtgatgttagggctacatgtaaagctaagatttgtgtcttactgaaatgaaactaaa

SEQ ID NO: 207009 - DNA, 417 bp, Human
ccaaattcatggtgttgacacggttttgtttgaaccagttatgaaatcagtagcatgtttgaaactatcaaattttggttccttttgaactggatatgttagataatacagctaattgtgttattgtttttaaaaacagagccacctttaaaatagcataaagtactttatcaatgaaaaaataccattatgaagtattttcaaatgtgacaataaacaaatgagtcttcagtttaaatttcatagcaaaattggctgaacgcggtggttcatgctcgtaatcccagcactttgggaggccgagatggatccctcaggagttcaagaccagcctgggcaacatggtgaaaccccatctctagggcaacatggtgaaaccccatctctaccaaaaatatgaaaattagccgggcgtgg

SEQ ID NO: 207010 - DNA, 601 bp, Human
aaacacaaaaattagctgagtgtggtggcacgcctctgtaatcctagctgttcaggagactgagcacaagaatcgcttgaacctgggagatggaggttgcagtgacccgagaacactcctctgccttccagcctgggtggcagggcaagactgtctccaaaaaaaaaaatagttggctgtaaatatgtcaattaatgtccaggttctctattctgttccattggtctatgtgtcttatttttatgccagtaccttgcttttttggttactacagctttgtagtatattttgaggtctgttygtattttgcctccagttttgttctttttgctcaagattcttttgcctatttggggtcttttgtagttccatacaactttcaggattattttatatttccgtgaaggatatcattggtattttgatagaatttatagattgctttggaggtagtattgtcattttaacaatactaatttttcctatccatgagtatgggatgtctgtttgtattgtcttcaatttttttgtaggtattttaattttattttttgtagctattgtgaatgagattgccatcttgatttctttttcagctagt

SEQ ID NO: 207011 - DNA, 601 bp, Human
ctctattctgttccattggtctatgtgtcttatttttatgccagtaccttgcttttttggttactacagctttgtagtatattttgaggtctgtttgtattttgcctccagttttgttctttttgctcaagattcttttgcctatttggggtcttttgtagttccatacaactttcaggattattttatatttccgtgaaggatatcattggtattttgatagaatttatagattgctttggaggtagtattgtcattttaacaatactaatttttcctatccatgagtatgggatgtctrtttgtattgtcttcaatttttttgtaggtattttaattttattttttgtagctattgtgaatgagattgccatcttgatttctttttcagctagtttgttgttttgtgtgtagagatattactgacttttgtgtattaattttgtatcttgcaactttactgactatcagttctaagagttttttggtagaatctttagttttttctatatataagatcatgttgtctgcaaacagggacgtttgacttcctctcttccaacatagatgccttttatttctttctcttacctaattgctc

SEQ ID NO: 207012 - DNA, 601 bp, Human
gagcataactttatctgttgtagaacctgctgattttgccagtcttttaaagcccatttttaatggagtatccatttgacttcatgaatattatataaatttgtcgtacatgtaggcttgtgtataatcatgactaaaaacaataataattatttttgtttctgcataattattcacttagcatttataggtttacatgacctagactgacgaattacatatttttatctcctgtaactggcatgtaattaacatagtacttcataactgcagatatgcataggtaatgatagtattcaagtaaaaatgcaaaaaaaaaaaaaaggagtaacgatgtacattcttagctaatttaatctgtttaaggggaaaccttactgaaatacagtttaagttttcgttttcattgtgaataattaaagaagagaacttgcattatttctggtatctctccatctcttttacactgtattgttcacaaaactgtttcgtgattttaagtgaacaaaatcagacttcagaataatatataatatctcatttttgtttgatgtgcgtttatgctttcttagaatatacaccaaaattgtaacgctggtta
